United States Patent 10,724,096 (METHODS AND COMPOSITIONS FOR INHIBITING AND TREATING NEUROLOGICAL CONDITIONS) - sequence listing, part 71

SEQ ID NO: 1518 - DNA, 3510470 bp, Homo sapiens (residues 1,755,236-3,510,470 of 3,510,470)
acagggttttgtcatgttgtccaggctgatcttgagctcctgatctcaagtgatctgcgtgccttggcctcccaaagtgctgggattacaggtgtgagccactgcgcccagccttaatgtgcatatagtacaaagctcattttttgattaaaaacacaataaatataaaataataataaaagtcaattaacttttattatttgaatttttagcagacacattgcaccttgtactttttaaaaatagcatctactcaactttattttttatgtgttttttttaatacaaaactccggaccttatttttctagtttttccacgaatgctccttttctgttctgggaccctgtgcaagagattccgttgcatttagtctcaggcctccttagcctcctctggtctgtgacagcttttcagtctttccttgtttttcatgaacttgaccattctgaggaggactggtcaggtattttgttgaatgttgctcagtttgggttgtataaagtttttcctagtgatttagactggaataatggatttttaggaggaattgcacagaggtacatgctatcaacatggcctatcactgatgctgaccttgattgtggaattaaagcagtgtctgccaggcctctccactgtccctttccttccttccttccttccttccttccttccttccttccttctttccttctttccttctttctttccttcctttcttccctccctccctccttcccactttctttcctttctttttctttctttctctttctttctcttttctttctttctttctttcttcctttctttccttcttccttccttcctttctctttctttcttttcttctttccttctctctctccctctttctttctttctttctctttctttccttcttccttccttactttctttctttcttttctttctttctttctttctttctttctttctttctttctttctttttctttctttcctctttctttctttccttttcttcctttttctgtcttctttccttctctctctccctctgtctctccctctctctttctttctttcttcctttctgtctctctttctctctctctctctccttctctctttcttttccttttcttttctttgacatggtctcactctgtcacccaggctggagtgcagtggtgtgattctagcaacattatccagttatttttaccttccctggcctcccatcccaaggaaaaaagagccaggaaggccttggctggaagcccttctgggctgcagccttgacctttgggctcaagcaatcctctctcctcagcctcctcagtagttaggactataggtgtgcactaggatgcccagctaatttttttatttttactttttgtagagacaaggtcttgctatgttgcccaagctggtctgaaactcctggcctcaagctgtcctctgcctcagcctcccaaaatgctgggattacaggcatgagccaccgcacctggtcctatttcccttttctagactcaagctatactccatatttattggaagccagttactaagacccgcttacactcaaaaggagtggaatcggtaagtgtggggtgtctacagatattatttaaagttctttgttaggaagacttgcctcttttaccccagtacattaatttattcaatcaatcatttattttatactttgggttttaaccttacactgtgttatttattttgttgctcaaattgttccagctttaatcatagtgagttttgggccttgcattcctgtgataagctgtcccttcctttttttttttttttttttgtttgtttgtttgtttgtttgttggagacagactcttgctctgtcacccaggctggagtgcagtggtgcgatctcggctcactgcaaactctgcctcccaggttcaagcaattctcctgcctcagtttcccgggtagctgggttacaggtgtctgccaccacacccagctaatttttgtatttttagtagagacagggtttcaccatctctactaaagagactaggctggtcttgaactcctgacctcaagtgatccacctgccttggcctcctaaagtgctgggatgatgggcgtgagccactgtgcctggcccgtccccttgtttttttaaagcacgtctttacttttcgtcactacaagatgctgcaggctcatcttgtattttctctgtcccagaccacaaacagccatttctccaaggagccatggttcctggagaataatagtgagaaatgaagactgggatgtggtgacaaactttaattttattgctctgtaagctttcccaagctccccattgggctataaacctcattctgcgtggtggttttgctgtctctctcaccatgttgcctcttgtacatacaatatctagtatttattgaatgaatgaagttcattgaaacaagttttagcttttttcttgattcttttaatattacactaattttacttttgtgtaacgccgtaatctagctagaccaagaaaatgagtcatgcctgattattattattattattattattattattattattattgtttgatgtggggtctcactctgtcacccaggctggagtgcagtggcgcaatcttggctcactacaacctccacctcccgagctcaagcgattctcccaccacagcctccagagtagttgagactacaggcgtgtgccaccacgcctgactaatttttgtgtttttgtagagacagggtttcgccatgttgctaaggctggtcttgaactctcggactcaagtgatcctcctgcctcagcctcccaaagtgctgggattacaggtatgagccaccacacccagcagagtcatgccttattttatctccctgtcattatgaaatgactgatatctcagaaaatgaagacatgaatgcatttgtaatgtattcatggagtatgtcctaccctgcatgcatttcaacagtagtcacccataatcaatgaatatttgtaattcttggttatttgattttattcctggccagaaatttaaaaaggaaagtgtgtagtaggaaaaaaaaaaaaaagcaaattgactgttttttcctactacacttactcaactccatgcacttctgtgaccatatgggtggggttttccttacatgtcagtactcccatgggtaccaactgggtatcctctaattcagttcaattctgacattatatacttggagtcagatcccacaagataaggactcagtcccacaagtctgcttccacctcagatgccaatagcaagtctgggcctctggaactgaccaactggctataaattaggggttcccaccaccctctccctaatgatttgctagagtggctcacagaactcaggaaatcaccatacttaatgtttacccatttattataagggatattacaaaggatacagatgaacagccagatgaaaaagatgaggcacagggcaaggtatggggagaggggctgtggagattccatgtcttctgatatagtgtggttgtgtccccacccaaatctcatcatgaattgtagctcccgtaatccccacgtgttgtgggaaggacctggtgggaggtaattgaaccatgggggcaggtttttcccatgctgtttttgtgatagggaataagtctcatgagatctgatggttttataaaagagagttcccccgcacctgctttcttgcctgccaccatgtaagaatgtgcctttgctcttcctttgccttccgccatgagtgtgatgcctccccagccatgtggaattgtgaatcaactaagcctctttcctttataaattacccagttttgggtatgtctttattagcagtgtaaaaatgaactaatacatcctgtatgggtaagacaccctccatgtgttcagaaacctagaagctcctcaaaccccttgatttttatggaggctttatcacataggtatgattgattattaagtcaatttccagcctctctccccttctcagaggatgggaatggggatggaagttccaagcttctattcttggcttggtctttctggtgaccagcccccacccagaagccccattgagagttcccatattagaacaagagatgctcccatcactcagaaaattgcaagggattaggaactctgtggcaggaaccagggttaaagaccaaatattggaacaaaagatgctcctaacatctctattgcccaggaaattgcaagggatttaggcactatctgccaggaactggagataaagatatatatatttcttattataaatcataatgtcacataaagatacattgttgctctgttcttttctaattcttttccttccatctatttccatatgtcaaaattggaccagtgtcccaaggcctaactaactccaaagccaagtctttccagttgcctttatatctctctgtctaaaatgagatctcccttatctctgaatcccatgagtttgtatttacactgtgatatttacctttttaaaattgtactcatttatatatgtcataatccttctctaacactgtaaattaatttctggcagggctcatatcagattcaacttcttgcctacaaatagcaacaagaaatcaattgtttaaagagaatttgaaatttaaaaaattatattatggctctgtaatagctaatttcagaatggaggaaaaagaacaactaaatcagttgatcagaaggaggggaaactatacaaattatgttctggctataaaattacaagtgattgttatgtagaggatagatagggaagctagtactacagtgaagttccccctttcattctcaaccccttaaatttggtccaaagaaactcaaccaaccaaccaaccaactaaaaaaaagtcgatacatttggtatcgaagaaggtatggtgaaaaggttaaatatatatagttgaagggggaagaatctggtctagaatgataaaagatgcacatacaagaaaatatattaccacgctgtttgcaaaaatgaaaaccagagcattttggaagcgacctgactgtctgtcaacagcaaatgactggataaaatttgatatagctatactatgtgatgttatgtggctattaaaaacaaattagatctctggctatttttccaaagacatgtctgtggtgggctgtaaagtgagaaaaggaaggagcagagacaggagttgagcttgattctagttttgtcaaaatgtcaacttacaggtcagggtaaggacctgtaagggagggaagagaaaacgggagggtaggagaccagccaggctagatagggacaaggttgcatgttctcccacaatgcgtccaggtagcctcttattctgaaaaagacacagtcaccttgccaacggccatgacctgctagtctcattgattctcataggaaagaaacatttgtgcccagagttttaggggatttgaggttccagttggggatttccctgaggagagcgcatgtcatcatgcattttgacgtcatggcatcttgaactttagataaaagagaaccaattcatgttgattttttgttgttgtggcatttaaaaactctgagctttatcttttagaggggtaagatgaaaaggagtgaagatcagccttcccctttttacttaatgggaaagggtttgtagatgatttaaaatgtcacttatttcattgaaatgaatgatacatttattaaagatgttcaaactcaccagtgtcagagatatgtaaattaaagtaacagtgagatatccctctcaggctgggaaaaaaaatggaaaagaccaatctcacctatattgttgatgggaatgagaattatttcagctgtgttttggccacatttattaacataaaatatatagatttttggaaattatataggactggatatataggaaataatataggtaataagacacataaattatatagaataatgataaaatgaacccatttccaacctaagaatgtggtcgtcaccaatactgttgaagccacctgcaagcttctctctagtccactttctctgccttctccgcctttctctagaggtatctactaccctgttctcttgctttgctcttttaaaaatagttaaagagaaatacatatactctttgaccccgtaatccccatcctgggactctatctcgtagacataaaggccatggtacataaggatgtttgtagaaaggatgtttattgcagcactgtttgtagtagccaaagagggagaaacgagtgaatgcccattaatgattgaacaaattacaggacatccacaccatggaattttctgcagctattaaaaaacgatgaattagagcaataccagatgccttggagggatttccatggcatattgtagaatgaggaaatgggagctgcggaagcgtgcataaaatgacaaatgcctatgtattatatactgtgtgtgaatacatatatttgtgtgtgatttatgagtatagagacaaatttggaaggatgtattctaaattgtcaatgaggattaacagaaagaggaagggtggtctgatgtggagggagaatggattaagccaaaagagaagaagaaaaaaacccaaattacctgggcttcatcagataaatggagatcaaaattccatcttattgttgttccagggcttgtaatatggttaggctttgtgtccccacctaaatcaaatctcatcttgaattgtaatccccataatccccacagatcaagggagagaccaggtggaggttattgaatcatgggggtggtttcctccttgctgttctcatgatagtgagtgagttctcacgagatctgatggctttataaggggctcttttcccctcttcgctcaggacttcttcctgccaccttgtgaagaaggtgctttgcttcctttttgctttccgtcatgattgtaagtttcctgaggcctccccagccatgctgaactgtgagtcaattaaacctctttcctttataaattacccagtctcgggccgttctttatagcagtatgaaaatggactaatacagcttgtgtgataatttcactggatgatgtgaaggcttttttgaaaatgttcaaggctctgcccaaatatgtgatggtggaatttattatgatatgcaaatgatacttataatagtgatgtgattttatttatttatttattttttttgagacagggtctcactctgtctctcaggatggagtgcagtggtgcgatcacagctcactgcagtctcaacctcctgggctcaattgatcctcccacctcagcctcttgagcaactgggactacaggcatgcaccaacacacccggctatttttttttttttttttgtattttttgtagtgactgggtccatgttgaccaggctggtcttgaattcatgggctcaggtgatcctcctgtcttagcctcccaaagtgctgggattacagatgtgagccactgcacgtggccagtgatgtgactttgagcaaataattttttattcttctaggtctaataaggttttatccattagacagataataataaccaacctcattaatagctgatatcctttcagatgaactattgaaatcactctgcctggattaaatgtagtcctcaaccatggcaaaattcaaagtatgacctgcttaacctgactgctaaatcctcccctgacccccaccacagtttcccctctgctaacaccttacatcgccatggtacttttgtctaaactcagagatgggaactggcgcattgcttgtaactaacctccagagtttatatggctttcacttttccaatcatgttctgtttctgttttacgatccaatccagggtgccacactgcattttgttggcatgaatcctcagtcatttcttgtctgtgacagtttttcattattttttatagctttttttttttttgagatggtgtcttgttctgtcacccaggctggagtgcagtggtgtgatctcggctcgctgcaacctccgcctcccgggttcaagcaattctcctgccttggcctcctgagtagctgggattacaggcatgcatcaccatgcatggctaatttttatatatttttttagtagagacagggttttgccatgttggccaggctagtcttgaactcctgacctcaggtgatctgcctgctttggcctcccaaagtgctgggattacaggcatgagccaccgcgcccggcctacgttttatggctttgatggtcgagatgtgctggccaggtatcctgtagaaagttccccgatctgggtttgctggatgccttctccagattatgctggagcagtttgtttttgtgtgtgttatccagactaatctcctcttggaataattttgcctatataaatgtgacccgccgggcgtggtggatcacacctgtatcccagcactttgggaggctgaggcaggttaattgcctggactcaggagttcgagaccagcctgggcaacatggcaaaaccccgtctctaagaaaatacaaaaaattagctgggcgcggtggcgcacacctgtagtcccagctacttggggggctgaggtggaggatggcttgactctgggagtttgaggctgcagtgagctgagatcatgccactgcacttcagcctgagtgacagagtaagaccctgtctctaaaaaaataagataaaataaaagaaatgtgaccctagagttgtgtgtgagtgagagagagagagagagagagagagtgtgtgtgtgtgtgtgtgtgtgtgtgtgtgtataagaggcagggtctgtctctgtccccaggctggagtacagtggtgcaatcatagctcactgcaaccttgatctcgtggtatcaagcaatcctcctgcctcagcctcccgagtagctaggactacaggtgtgcaccaccactgctagataattctttttttttctagacgtgtggtttcactatgttgtgcaggctgaaactcctggcttcgagtgatcctcctgcctcagccttccaaagtgctgggattacaggcatgatataccaggcctagcccctagaggtattaaatgggggtattaacttgtctttttattcttcatttaaatgattgcaaatgctatccaatctactcccgagaggcccctcagggagttagtttccattttacagatgaggcagccggacccttctgcatggcagagaggacattccaacccagatgccagtgccagaggctgcccatagctccgctactgttgagctgctaacaaattggtttgtccaagggcatgttcaactgtaaccctccgttcccctttggagaaacttcactatcacctaattaggtaacatggtaactgggcaaccattacttataatagacgtggagttgtaaattattctatttaattaagaactgcacatttcctattaaaggaaagcttatcataggttagtaaatttattgggaacacttaactttagctaattaagctgtttgaactcaaggcgagggcattcattaataaccaagcccaagcagttaagggcaattagtgaaacagctggtctttatctcactgttaaaggatggttaatagagatctttgcagctcttataaacctccccaaagcaatatcttcttcaaaagtttgcattggtaaagaaaatagaagaggaaactaaacataaaagaatggagtgtcggaagcagtctggatctctaggctcatgatgatgccagaaaaaaatgaaatccagaggcatttcctagtggtcctcatctttcctagtggtctgcatttacctgggagagtttgacctcgaagtcagcagtagatgtgttttagctcccccctggaatcttggctgccccaggagcatggggccagggatgggtcctttatatatgcagagattatatgtcctgaaagaaaaatgcaggaatggtaacctctcattcagaaatgcagccaggtagccttagacaaaatgctttttttggatctgcaaacgtctctatgtagaaagtctcacagagtcctcatatgtcttattcagtaatttgtcagatttttttttttttttttttttttggagatagggtctaactccgtcacccaggctggagtgcggtggcgcaatctcaactcatcacaacctcagcctcccaggctgaagcgatcctcccacctcagcctcctgagtagctggtactacgggcatgtgccaccatatcctgctaagttttttgtatttttaataaagacgaagcttcaccatgttgtccaggctggtcttgaactcctgagctcaagcgatcagcctcccaaaatgctaggattacaggcatgagccgccctacccagccagcttgaacttttatttagaaatgttaaaatgtgcatagttattaggattatcttgtgtttcaggaatcaactgtcattatgtatcctgtgattggagggaaatgagtaattcttaccctacctgcaaatagttgtttcttggtcagatggtagggattctggttggggatggtactttcatcactctgccttcagacatgtattgattgcctgttgtatgctgggcactatgctggtatgtgacatcacatgagagcatcaaggagcctgtttagcttgcaatccaatgagagaagaatggacagtaaacaggtgttgtttttgtttattaaaacaaggtaatctttggctgggtgcgatggctcgtgcttgtaatcccagcactttgggaggtggaggtgggaggatggctcaaggccaggagtttgagaccagcctgggaaacatagagagaccccgtctctacctaacagaaaaaattagccaggcatggtggtggcatatccctgaagtcccagctatttgggaggctggggtgggaaaatagcttgagcccaggaggttgaggctgcagtgaactatgattacgccactgcactccagcctgggtgacagagtgagatcctgtatctaagaaacaaaaaaacaaaaaacaaagtaatcatggactatgatcaatgctttgaaggcaaagtggttatccaaattcagcctttcttggttgttgccttgccttataatagtgtctgcttcatatttcctttttagttggctcatattgctttaaacttaaatatatttatttgaaatgaagaccttatattcctacaataagtgggaagccagtatcacttatcagaaatggaaactaatcagaagaataaatacataactattaaaatgaaagctgtcacatgttctcatttatacgtgggagctaaatgatgagaacacatggacacatagaagggaacaacacaccctttcagagggtggagggtgggaggagggagaggatcaggagaaataactaatgagtactaggtactgggtgatgaaatagtcaaacacccgtgacacaagtttacctatgtaacaaacctgcacttatacccctgaatttaaagtaaaagttaaaaaaattcattacctcacatacttagttttggagggttgaagacatttaaaatctactcttttagcaattaataataaaggttttttttttgtttttgtttttgtttttttttttttttttgagagggagtctcacactgttgcctgggctgaagtgcaatagtgtgatcttggctcgctacaacctctgccttctgggttcacgcgattctcctgcctcagcctcccgagtagctgggattacagtcccacaccaccacacctggctaattttttgtatttttagtagagatggggtttcactatgttggccagactggtcttgaactcctgacctcatgatccgcctgcctcggcctcctaaagtgctgggattacaggtgtgtgccaccatgcctggctatttttttcgtgtttttagtagagacggggtttcaccatgttggccaggctagtctcgaacacctgacctcaaatgatctgcctgctttggcctctcaaagtactgggattacaggtgtgagccatcgtgcccagcctaatattaaagttttctttggttttagtaaatgaaaaaaataaaaataaaataaaacctgtcttctgccacctaaaaacagcccaggaagtaccagcagtgtgcatgtcatattttggaaatattggcatgagttgaggggtaactgaggatgccacctgccatgtgtgcatgcatgtgtatgtatataaccacctgaaagtagattacatggtacttcactcttaaataatagtgtgcgttgtctaagaacaggaacttctactacataatcataataccatttcacacctgagaaaatgaacaatagagcctgatattatttaatatatagtccatattcatgctttcctcattggcccaaaaatatttttatagctttcttcttgaacccagatataatcaaggcttacacactgcatttggtcactaggtgtttttagtctaaatctataacaaagtttggtaatcattttctagaaagggccgggtagcaaatatttttggctttgcaggccatatcatctctgttgcagtcacttaactctgctcttttcatacaaaagcagccatggacagtaagtaaacaagtgaacatggctgtattccaataaaacattatttacaaaaacaggtagtgggccagatttggtccacaggataacaccaaactcacttccccttttaaatgaaattggcttaaaatccttccttttaaagttgcagcatgtggcattgacttttgaaaaatctcagccagatgtcttgtagaatgtcccacatttggatttgtccgaagtttcctctgggtgttattgaacttgttcctctctcccctatatttcttctgtcctgaagattagtttcagaggcttgatttgattggggtgaaacatttctggcaagaatccttcaaggtgatgccatatctttcacattgcatcatgccaggaaacatgtatttctttgctccccacttggtgatgccaagtttgagcccttggctagggacataacaccagacctctccattgcaaaggtacatttcccctctggaattagtgcataatatgcaggcttctccctctgtctggaacacgcctctctgtggtcttcctttgggtggctctttctcatcatttgagcccccactcaagcatcagctgccctgagagcaggacattatgcaactgctcttaggtgctctcaaggccctgcatgctgtggccctggccacctccctggagtcatcttggacattctcctctttcctgttgcaggtcagccatgctggccatctttcactgcatggagtgcaccgtgctccctctgtcctatccttgcctggagcacatcactctctgcctcacccggctaaccccttctcacacttctggtattcactagggggtcctatcctgaagggtgtcttcctagactgtcctccccatcccagtttgggcaaaatactgctgtcaaatgttctcaaagtaccacataagtttctttttgtaagggctcatcacaacggaaatttttcatttttaatgtggttattatattagtctcccctaccctccctagaagctgagctccataagggcaagaagcctgcctaattttgttcatccctgtaaatatccaaaacacctagcacagtgcccagcacatagtaggtgctcaataaatatctgttgaataaatgtatgaataatgacttgttgaatggctccaatgggaccctatgctaataggatcctgaagggtcagccctatttagcactcggaatgatctagaccaggaattggcaagctttttctggaaatggccagatagtaaatatttttagctttgtgggccatacattctctcacggaattattcaagttggttgtggtagtgaaagcagccaggggaaatacctaagtgaatggacagagctttgttccaataaaaatttatttacaacaggccaggtgcagtggctcatgcctgtaatcccagcactttgggaggctgaggagggcagatcagttgaggtcaggagttcaagaccagcctggccaacatggtgaaaccccatctctactaacaatacaaaaattagccgggcatggtagcatgcacctgtaatcccaactattcagaaggcggaggcaggagaatcgcttgaatccaggagatggaggttgcagtgaacttaggtcacaccactgcatcccagtctggatgacagagcgagacttcatctcaaaaaaaaaaaaaaaaattacaataggaggcgagccagattggggctgtgggatggagttggccagtccctgatctaggggcattattcctggtttcatcttaattttgcttcatatttattgaattcctgctctgtaacaggcatgattctggattctgggaatatcacagtgagtgagactgacaatatctttggccacatgaagcttactataaatgaatgaatatttgactagagacagacaataaagaagtaaatgaataatatcatttcacacatgatgatgtgttccatgaaaaataattaaactgggtgctggaatgctgaatgactgagttgaagcctaggggctgctcttttaaatagaatggtcaggttaaattaggggcaatttgagcattggtaaaaaggatgtaactgaatgtcgcacactggagaaataaaaacccatgagtcaatagtgtgtctaaagagaaagggagaagtgaaggaggaaagctcttagttagggagctaactaatccttgtaaaaggatcggtagaattaaaaatcatggccaggagtggtggctcgtgcctgtaatcccagcactttgggagactgaagtggatggatcacttgatcctagaagttcaagaccagcctaggaaacatagtgagaccctcattactactactaataaaaaatattatccaggcatagtagcacacacctatagtcccagctatttgggaggctgaggagggaggatcgcttgaacctggggaggctgaggctgcagtgagctgtgatcgtgctactgcattctggcttgggcaacagagagagaccctgtctctaaaaaaaaataataaaataaaaatcatgtttcaagccccattgtaataattgattcatgaccagcctgggcaacatggtgaaacccgtctttactaaaaataaaaaaaattaggtaggcatggtggtgcacacctgtggttccagctactcaggaggctgaggcagaaggatcgctcaagcccaggtggtggaggttgcagtgatccaagatcgtgctgctgtactccagcctgggtgacagggtaagactttgtttcaaatgatactaatactaataataattgattcatgtaagaatcatcttccccaagaaagtacaattgagcaagagaagaatgatgagatgaagccaccaggaagaaagcgtggggaagggtgttgcaggcagagggaggggacagtgcagtccctgtggcttgcttcagagacagcaagaagatctcggttgctggacagaggaggagaatggtcagagatgacagacccagggcatgttgggctttgtaggtcctaaggaggagctaggattttatcctaagtgtggggggaaaccatgacagtctttggaatggaaaggaggtaagatggtttctattttaacatgattctgcctgctactgtggcaggagtaggttggcaatggggtggtcacagtggaagagggagaccagcaaggggacttccaaagtcatctgatgcaagaaatgatgtggtgtcagcagaaggggtgagaagtggttgcagctggcatatacatttgaaggtagaactcccagggtttgaattatatgtggatgggaaggaaagagaggagttgaggatgactccaaggtctcgaggctgaataatctgtgggtgggagccatgttgggggaagaccctcagaggcctcggtttatgaaagaagcctcaacaactgtattatgatggatacatgccctgtgtgagatgcctgttagacatctcagtgacatggagtaggcaggtgtaggaggtacgagcctggagatagttgagagttattggtctatagctgattaaatcacaagaggggataagatcccttagatagaggagacctaggattgggaaaggcattaggggacacagaaggggcagctggttaggtaggaaaaccaggaggatgggaaccctagcaccagttcagaaagaatttcaagaacttagttcccttatttccccttattgtattttttcacccctttaaaactcattttggcctgtagcagtggtaaacaatagctctgacagtagtaacagtaaaggcagccagcatttatacctgttctgtgccacacagatgctaaacaccttacctgctctatctcattgaatcctcactccagctccttgatgtgggctttattattatccctggtctaaactgagcaaagtgaggcccagagaggttgagtgacttgcccaaagtcacacagctcataagtgacagagccagaattagaaccctacatgcctcaaatcttttcccaaaataggttagctataaataaatgtcctgagaagctcctgggaaaagggtagtggttgatgggaggacattcactctggtatttaaggaactgctattcatcagtccagaaacagaatagaggcagacaatacaaaattcctgctcttctgggggagcctcagtatcctcatctgtgaaatggggataataaatatatctacctcatcaactttttgagaggattcaatgtgttaatgcaacaaatctctcagaacagggcctaacatgtagttgacatacgagacatagtcattattgagagactctatggcttcatggttaaggattgggcctcctagtgccaggatgtctgggttcaaatcccaactttgctactccctagctgtgtggcactgggcaaattccttaccctctctgtggcttaatttccccatctgtaaaatgggataatgatagtttgtagctcatatcattatgatgaaggtttactaagctaatattttgaaagggcttgaagtagctggtacatagttctcgtgttttagctgttatcatggggttgggatacagtggggacacaggcaacaagcacgcctgtcagtaaagaaacatgttatcatctgtgagaagaaagcatggtaaataaaaaccctgctggatttccacgtgcgtttccgtgacaggcggcctggattaaagagtcgagaagtcacagcgggaagagctgtcctgttcccagaggcaaatgacagcccacggaaagaaatagcacaaagcttcaggacggggagacggtgtcccgaggaaagagaggaggagcagaggatgctgcgaatcactgtaatattttccctaggaaagtcccaggggttcttgtagaggccttaatctcctattctgggcttcggatgccggtagctccttgctctttgagagctgcgttccctctggcctctgtctgtctctgttagagcctaatcatatttgaaagtagtttttatctgtgattattcatctgtatatgaggagcttatgtgtctaagctgccacttccatcaaatccaagcgcacggccccgttaatacgcacaggcctgacgttggcagggaaagtggtccccacccctagtccaaggagggagattttagagagttacagggggccagctttgggagtggggaggtggaggtagacagtgctggcatcaagacagggagcaaaacaaatatgagagacctaatagcaggaattccagccaggcccgtaaatcgataggtgggcttaccctcaaggcatggcttctcaaactttaataagatggtgtctatgaagattacatattagcttagagaacaatatttcatttttgctggctctttttaatctgcgggagatgatgtgctgggctaggtttaatgctcacacacatatttcagtttaattttctgttaaattgtggtgaggttagagtggagttttttcccctcttcccagggtggggagttctgacatcaggaggcagacagccagcggggaatcaggccaaggacaaagttgggcggccccccgacctacgacaaagacaaaatcatttgattatccttgcttctcctgcggatgtttgtttctttctctctctctcttttttcctacagcattgcgatgtaattcacataccatgcaatttactcatttaaagtgtacaatctgtccaggcacggtgtctcatgcccgtaatcccagcactttgggaggttgaggtgggaggattgcttgagcccaggagttcaagaccagcctgggcaacaaagtgagaccttggctctacaaaaaataaacaaaattagctgggcgttgtggcacatgcccgtggtcccagctacttgggaggttgaggtgggaagatctcttgagcctgggaggttgaggctacactgagccgaattgcaccactgcactccagcctatacgacagagcgggaccctatctcaaacaaacaaacaaagaaacaaacaacaacaacaacaaaaaaaatggaggcttgtgtactgtatgtttacacatttaagcataaaccaatatatgtcatatcctcttaccttggcaaaactccataatgataagattaaaacatacaatagagctaaggtttagctctaatgttactggaagttgacacaatatcaaacatcactcaattaaacccctgttatttttggatattctgttggtggactggctggcaatgtttggatgaataaaagaaaaaagacacatataattcacaaattagatatttcataaaatttctttctctggctttaattttatcaaagtcactaataatgttgcttttgagaccgagtcttactctgtcgcccaggctggcatgatctcggctcactgcaacctctgcctcttgcgttcaagtgattctcctgcctcagccttcagagtagctggaattacaggtgcaagccaccatgcctggctagtttttgtattttgagtagatacggcatttcgccatgttggccaggctggtctcaaactcctgacctccagtgatccacccgccttggcctcccaagttgctgggactacaggcatgagccactgtgcccagccaataatgtttttataatcaagagttctaccaatttgcttctattgacagcaatgatttagtcattacaaaataaaatattattggattaaaactatttggatatattttcaccaagaaagtatatcatagtaaagataaaatggaaaaattaaagttatttttcgtatatgttttcaaaacattattttttctttaggtatttgaaattatttattacaattaaaaggtacaatgaaaattatgttagtattaacaattaaatattaaacaattaaaaaaatgaaagttgaaatttaatttttgaaatttgatttagatcttattacatatttttatttaaaaactattcataattctagttttctatgtctgttcagttgtcagtttcaagagtcattcagtattatggccagatttatgaatatacataattaagagtacattttttttgaaacagggcatcattctgttgccaaggctgaagtgcagtggcacaatcatggctcgttgcagccttgaccctctgagctctatcaatccttctgccttagcctcctgagtagctgagactacaggtgtgcaccaccacgcctggttaatttttgcatttttgtagagatggaatttcatcatgttgcccaaactgttcttgaactcctgggctcaaacaatcctccagcctcggcctcccaaattgctgggattacaggtgtgagccaccgcacctggccatgaattctttctactgcaacattttccgtggccgtaatatgcaactgtcaaaaatgccatactgattctagaaccacaaattagaacacaaagagaagcaagaaacaggcagtcagcactatggggaaatgatgttctgctctgcaagaatctattacccactctatttgagaggaaatatttgacaagttaatttgtccttttctttcctaagtgcttttgtgacccctgcacaccagagcagtacccatctctcctttaggctgtagtactgcacatgaaccttcaaggtgtttgggcacagttgccttttgttttgaggacagagatcaagatctgggaggcagtgcttctctggggcctgaatggtgttatgtattagggtgggtgtttggagtaatcaatgcgttttgtcagggctaggtccaggtcccaggtgactgagtggcccaggacaggagcccctgttgctcaggtctaagggtggccttgcagatgtatgtggggagacagaggttcagagaagaacttcaggactgaaacacctggatagcatctcggaatgcataaaccatccctttggatgcctgtggaaacttctctccatatttcttatctaaatggtgttttctcaacttctgatttgaccattctgtgaataatcctaagggttgaaacttttatgagttaagtggtgataggcttttccattttatttgaggatgcaagcattattttcctaacagacagttttcatctgtgggccaaaagcattgtcacaggtacatattctgaaatattcttatctacagataaagaactcagcacacacggtggtgtttgaataggaaaagtgaaaaacaaaccattcacctcacgtgatcaattttatttgggccattagcagagaatattttgcactagagacttcttacatcaagtaataactgaatgttaagcaaacagatcatcaattattaagatgcagctgctattaacataatcatttacatttcagtaatatcagcatttggagggggttgtaaagctacttaaaagcatctgatgtacaaaataggaatttaaccatgttccctttgctaaaattttttagaggatctagctctaattttccacttaagaatgggtgttgtgattgggagaggtgtaaaatctgatgtagaaatatctgatctctggatacctttttttaattggtgaaactcaggatgacttccttttgtgaacacattttcattcattcattcattcattcattcattcattcattcattcatttaaaagagccagggtcttgctcgtgatccaggcaggagtttagtggtgcaattatcacttactgcagcctcgaactcttgagctcaagcaattctcccacctcagcctcctgagtagctaggacgacagacacataccaccatgactggctagtttttaattttttttgtagagatggggtcttgctctattgcccaggctggtctcaaactcctggcctgaagcaaccctcctgccttggcctcctaaagtgttgggattacaaggcatgagccactgcacctggtctatatttttggaatatagataatacattcatatggctcaaaaagtaaaaagtaaaaaaaaaaaaatacagcgaaaacccttccttctttctctgtcttttttggcctacagtgctccgtccccagaagtaatcactgacgtcatgatcatttttatgtacctgttcagggtttctttgtatatatcagcaaatactaattttgactcatttcacacagttttgagccgtgggtcttttgcttttgtttcttattttccaatatatcctggagattattccaaatcagcacatagagagctccctcattctttatttccagccccatactacctgttgtaggttgtaccatactttatttaaccaatctgctatagagggacattggattttttccaactatttcttaggccaaacacattgtaaggaataaacttgtacttgcatgaggcacgtgcatatacttttacatatatttaggataaatttctagaaatggaatttctgggtcaacttttcatgcatatgtaattctgatagatgttgccaaattatcctccatggtgatagtagccttttgcgattccactagcaataaacgagagtgcctgtttccccaaggctggctcatgttttgaagacctgctcaagtagaggctatctgctcagcaccgacttgcaggggagaatagcattgttttattcgtattctccaattactctgctacttttcactccttgccttttgcttgctgtatgactgtgccttagtttcctcacctgtaagatggggctctaagaatacctacagcctacagtagttgggagagttccaggtgctaatgccaacaaagcactaagcacagttcagacacagtaactgcttaaaaatgctgttattaagagggtcaactacatgacaccacccagagattattgcaactctgcttctcttaggccacagcagacatgaatgtccatgttgtaaaataacaaaggcactgaacattttcttggaagaagaggaattttggttctaggtaaatgtgagccccctctgttgggtgtaattggagaagaggaaattggaggttttgagtggaaaagagtggtaaggaggatagtgaagcagaagcagatatttctgcaatgagccttggaggcggaaaacaaactgatgcctgagagagctttggcactgaaacccctgtctataggaggaggttcctgaactctgtgtgtcacaggtgctgagtgccccaggtattaaccggcctgaagttatcacctggacagctaaggctctagaatctgagtattgaggagactggagacagagctactcacccgggccaagtggaattggcagcatagctttatggttggaggctttttgtctggaatcaggcagccctgagttcaaatgctgcctccatcacttgctagtgggctggcctaggataagttcatgtttctgatcctcactttcctcatcggtcatctgaaggtaaatgccagagtagggggcattcttaagatgcttgtattttcacagggaggctcggggattacaggctggaagagttctaagacacttagcactatgcctggcacatcttaaacacttaataaatgtcagcagctattaaggatatcacatgaataaggttttacaagcgtgctgtttctgggatacaagggggaccctgaggggtgcatgttaacatattcaagttgtaaaaccagaaaagacccatttagatggctgtacagttatagagaggaaaaatgcctctcagcatacatgttatttgcaacaaagcaaaacaaatttgtgagcttcttattgcagatgaagcagagggagagcctgaaaaatttcctgccgtcttgaggcagtaaatagaaaatgggttgtatagtactgattgctgctaatttaagacatataaaaatcactgatggcctctttttgttctccacttttttctctgttatttactaaaggtaaaatagtcacacatttacatacattatctttgtccttgtaactcatttttatgttaaggatatatattccttattctatctctttcacttatttttgttccaacctaccattccctgtaagaatttaatccttgtgcttgggaatgaagtgtacaattctccttgcctagaatgctctaatctgcctgctgctatgcttggcaagctcttagtcctcaaccagctattacctttgcgaagtatttctcaagatcaccagcctcgatggccctttcttctttgattctgtgaggctctttttaatgtttcttttatagcatttttcatactgggctctcattctttgtgtacatatccgtctttccctttatactgggaaaactttgagtcaagagtagcatctctccctctcttccttcatcaaacatgtattaagcgtcagaccctgtgataggatctgtggatacagaaatgaattagacacagcccctggtctggaagggagatctcaagacaatgtgggagcaattaaagaacgaggcactgaggtaaaaccttacataatgctttcgtttagtcttccaaatgaccttagatgcatctgtgaggattcccattttaccattgaaaagcctgagctaaggagaaactataactcatgaaagaacataaggctaccaagtgttcacaattccagcctcaacgtggcccccctggaggaggcaaggcccagcaatgtcatgactgtgaggatttggccagatgaaggagtcaggggaaggaactccaggaagagagacaaggctatgcaaaggcttaggggtgagggagcattgctatttagggaattataaaagtattagtcatctcaggatttccggtgttcacacagtgctcagtacacagtagatgctcactgaatattgtaagaatgcattcctgccgctaaagtccccaaaacttgtaattcaactcaggacccgagtttcttgtgttcctcagtattcttcagtaaattctcatttttgctgaggttctggcttgcatagacccgtggcccaacttggaagagtgtgccctcaaactgtctccattcagcctttcagaaatacagttcagaggcttcctcccccacttctaccctttaaatgtccagggactgtttctacatttggttcagacagactgagcaaaattttggacatagatggacaattgctggatagacagctgatggagtgtcttgactgagaccgtctgtaggctacacagctctggggtatgtgaaaactgcccccagcagatggaagtctgagctcaagaaacaaaaatctaagggaagttgcttttagttcagccataattcctaactcttggatctctttctcatctgctctcctgcccatagacctggggaatactgttttagactggaaggggtggggcagatggagaaactgttctctttcttttgcttttgctgaagacatgttgtcaaggctaggaatgttctttcttttatatgggatgtcagttaatagaaaggactctggagccagactgcatggggtttgaatcccggctctgctacttaccagcttcttgaccttggataagttacttaacatctctgtacctcagcttccctatctgtaaaatgggattaataatagtacctatttcataaggtttttgtgagagtataaaggaattaaaatatttaaagcacttagaacagtacctggaacatcttacgtgcaatatatgtgacgatgatgattgtgataattaaagttactctacacaaactccctcctttcttctggttcatttgtactaaatggtaatgtcccatttagtctcaaagcccaatcaaataggaattagttcttattttctttgaagacatggtgaatttagactctaagttggtaatatcatgtttaagctgtctagcacggtaaaccaagaaaagaaaaacaaaataataagatttcagatgaaaatagttgggctattcacatgaacaaaataccccaggttgtttgagttgatatattactcaaaaccagaagaaacttgatctagtccacttactgaaattttgatgggtaaacggaagcacagagaactgactaatgcagggttatatagggctagacctagaatatacttctcctgatccctgttcatgttccttgcaatgccctgtagccaaaggatgttcactctctgaagcttctcaaatttttttttaatgataagggtcagcaaatgctttctgcaaaaggcctgatagtaaattattctgggttttgttggccatctgtctgttaccaccactcaactctcccattacagtctgaaagcagccatagacagcgtgcaaatgaatggatgtgactgtgttttaataaaattttatttataaaatatgtggtgggccagatttggcccatgggttgtggttgcaaatctctgctctatgatatccccagctgaagtgttaaagggaaataccagagcaataaatgctcttctacatgaaacagaagccattagccaaatgcttaatgtgaagaagtagccagaggaaagagctgtggtgtgtgaagtaatgaggatgattaggcaaaaaccagctttacttttccatcccagctaactcagtttctttttatttataattttctaaaagagggaaaatagagatggaaatttttctacctaaacagtgggattaagagaaaaaattctgtaatgtagttttggttaccatggcattcctggtacaacttgccagaacatccaaataaaaggacaagcttttatctctccctgcaactcaattaattttaatctataagatgagaattatccacttagcttccaagattagcttgctttattagggtatcaaaaaataagcagaaagaaaagaaaatgtgcttgaagatgacttgctttcatttgagaaaatcagtccacagttaattagggcaaaacttagaggctgcagggaggttagcagagtgagatttaatcattgtcagataagtgtacagtcaagaaaacaccatgaaacattctctctgtgaggtgcatagttacctacatcttttggaattgtttatgatggggatgtgtattagttatctgttgctacacgataatcacacccaaacttatcagcttaacacaaaacacatttgttgtctcacaatttccatgatcaaaaatgtaggcacaatttagttaggtgttctgtgtcaagagtctttggataaggctgcaattaaggttgtcaacctggctgaggtttaatttgaaggttctactggggatgaactcccttccaagttcccatggctgttagtagggttcagttcctcaagggttgttgtactgaggccctcagttcttagctggctgttgtctggaggctaccctcagttccttggcatggaggcctctctagtatgtcagcttgcttcatcaaaccatgcaagccaagaagacaatagagtctgctagcaagatggaagttacaatctttttttttttttttttttttttcctctggagacggagtcttgctctgtcgcccaggctggagtgcagtggcccaatctcggcaagtggagtgcaagctccacttcctgggttcacgccattctcctgcctcagcctcccgagtagctgggaatacaggggcccgccaccacgcccagctaattttatttttgtatttttagtagagacagggtttcatcgtgttagccaggatggtctccatctcctgacctcatgatccacccgccctggcctcccaaagtgctgggattacaagcgtgaggcactgtgcccggctggaagttacaatcttacataacttaattatagaagtgacagcccatcattgttgacatattctattgattagaagtaggtcacaggtcctgtccataccaaaaaaaaaaggaaccatgcaaagatacgaaggtgaagaggagaggatgatcgggggacatcttagagtctacctgctacaggaagagagaagtaatgatttcagtgaagtagtaatgagagaaagtacactgtcttgataagaagatctctgaagctgaatttactctgaaggatgttgtgatcattgagtatcatgggccaaagaggagggataacgtgtgcatatatcataccgttgctattcctaactacaaactctggtttctgagaagtttaaactgtagggagaccatttatcctcattaaatctagatgctgggctataacattgggtaaaccgagcccgtgtaacagttgggtctcttttagtgacaagcaacagaaaatccaactcaagtggttaaggaaagagagaatgtattagcttatacagctgaaaactccaagagtaaatttcacttcaggtgtagctgggttcagggcttcagcaaaatattttatttgtttacttttttggttaaggttattgagacgtaacttgggtatggtacccttttcgtacacagtttagtgagttttgataaacgtgcagttgtgtactcaccaacataatcgggatatagaacatttccacaatcccccctccctaatttttttcttgtccctttgtagtcaacttctcctgctaccctcagcccctgacaaccactcatctcttttcagtacctatagttttgcctttttcagaatatcttttaaatggaattaagtagtctagatgtactcataagattatgtgtctggcctctgttactcactatcctgcctttgtgtaggagtcatctgtgtaatcacacctctgatttctttttatcactgagtagcccattgtacagatgtacagtgatttttaaaacctattaaccaattgcaggacatttgatttgttaccatttttggcaactgtgaataaaactactagaaacgtttgtgcatatgttttttatttgtgtgtgtgtgaatgtaagttttcattgttctggtaaacacctagtagggaagttgcttagtgatacagtaaatctgtatttaattttataagaaactaccaatttgttttccaaaatgggttgtaccagtgctgggcacagtggctcacccctgtaatcccagcactttgggaggtagaggtgggtggatcacctgtggccaggagtttgagactagcctggtcaaaacagtgaaaccccatctctactaaaaataataaaataaaataaaataaaataaaagttacttcctattctcaccagtacttgttctcactcaccttttaaggtttattttagctattctaataggtgtgcggtgctatctcaaggtacttttaagttacattttcctgataactaatgatgtcagtcatccttatgtgtttatgtgctatctgtatgtcctccttggggaagtgtccatgcaaatcttttcccattttaataattgtgtacttacctattttgaggataaatgttattcttttttaaaattattattatactttaagttctagggtacatgtgcacaatgtgcaggtttgatacataggtatatatgtgccatgttggtttgctgcacccatgaactcatcatttacattaggtatttctcctaatgctatccctcccccagtcccccaccccccgacaggtcccggtgtgtgatgttcctcgccctgtgtccaagtgttctcattgtctggttcccacctatgagtgagaacatgcagtgtttggttttctgtctttgtgatagtttgctgagaatgatggtttccagcttcatccatgtccctgcaaaggacatgaactcatccttttttatggctgcaaagtgttccatggtgtatatgtgccacattttcttaatccagtcaagactgatggacatttgggttggttccaagtctttgctattgtgagtagtgccgcaataaacatacgtgtgcatgtgtctttatagcagcatgatttatagtcctttgggtatataccctgtaatgggattgctgggtcaaatggtatttctagttctagatccttgaggaatcgccacactgtcttccacaatggttgaactagtttgcactcccaccaacagtgtaaaagcattcctatttttccacatcctctccagcatctgttgtttcctgactttttaatgatcaccattttaactggcatgagatggtatttcattgtggttttgatttacatttctctgatggccagtgaagatgagcattttttcatgtgtctgttggctgcataaatgttttcctttgagaagtgtctgttcatatcctttgcctactttttgatagggttgtttgtttttttcttgtaaatttgtgtgagttctttgtagattctggatattagccctttgtcagatgggtagattgcaaaaattttctcccattctgtaggttgtctgttcactctgatggtagtttcttttgctgtgcagaagctctttaattagatcccatttgtctattttggcttttgttgccactgcttttggtgttttagtcataaagtccttgcccatgcctatgtcctgaatggtattgtctaggttttcttctagggttttcatggttttaggtctaacatttaagtctttaatccatcttgaattaatttttgtataaggcgtaaggaagggatccagtttcagctttccgaacatggctagccagttttcccagaaccatgtattaaatagggaatcctttccccatttcttgtttttgtcaggtttgtcaaagatcagatggttatagatgtgtggtgttatttctgaggactctgttctgttccattggtctatatctctgttttggtaccagtaccatgttttggttactataaccttgtagtgtaaagtcaggtgtgtgatgccttcagctttgttctttttgcttaggattgtcttggctctaaaggctcttttttggttccatatgaactttaaagtagttttttccacttctatgaagaaagtcatttgtagcttgatggggatggcattgaatctataaattaccttgggcagtatggccattttcacgatattgattcttcctatccatgagcatggaatgttctttcatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctttctgttcttggtgtacaggaatgcttgtgatttttgcacattgactttgtatcctgagattttgctgaagttgcttatcagcttaaggagattttgggctgagacgatggggttttttaaatatacaatcatgtcatctgcaaacagggtcaatttgacttcctcttttcctaattgaataccctttatttctttctcttgcctgattgccctggccagaacttccaatactgtgttgaataggagtggtgagagagggcatccctgtcttgtgccagttttcaaagggaatgcttccagtttttgcccattcattatgatattggctgtgggtttgtcataaatagctcttattattttgagatatgtcccatcaacacctagtttattgagaggttttagcatgaagggctgttgaattttgtcaaaggccttttctgcatctattgagataatcatgtggtttttgtcattggttctgtttatgtgatggattacgtttattgatttgcgtatgttgaaccagccttgcgtcccagggttgaagccgacttgatcatggtggataagctttttgatgtgctgctggattcggtttgccagtattttattgaggattttcgcatcaatgttcatcagggatattggtctaaaattctcttttttttgttgtgtctctgccaggctttggtatcaggttgatgctggcttcataaaatgagttagggaggattccctctttttctattgattggaatagtttcagaaggaatggtaccagttcctctttgtacctctggtagaaattggctgtgaatctgtctggtcctggactgtttttggttggtaagctattaattattgcctcaatttcagaacctgttattggtctattcagatattcagcttcttcctggtttagccttggaagggtgtatgtgtccaggaatttatccatttcttctagattttctagtttatttgcgtgggggtgtttatagtattctctgatggtaatttgtatttctgtgggatcggtggtgatatcccctttatcattttttattgtgtctatttgattcttctctcttttcttctttattagtcttgctagtggtctatcaattttgttgatcttttcaaaaaaccagctcctggaatcattgatttttttgaagggtttttttgtgtctctatctctttcagttctgctctgatcttagttatttcttgccttctgctagcttttgaatttgtttgctcttgcttctctagttcttttagttgtgatgttagggtgtcatgggagactttaacaccccgctgtcactattagacacatcaacgagacagaaggttaacaaggatatccaggactttaactcagctctgcaccaagcagacctaatagacatctccagaactctccaccccaaatcaacagaatatacatccttctcagtatcacatcccacttattctaaaattgaccacataattggaagtaaagcactcctcagcaaatgtaaaagaacagaaatcaccacaaactatctctcagacacagtgcaatcaaattagaacttaggattaagaaactcactcagaaccgcacaactacctggaaactgaacaacctgctcctgaatgactactgggtaaataactaaatgaaggcagaaataaagatgttctttgaaaccaatgagaacaaagacacaatgtaccagaatctctgggacacattaaaagcagcgtgtagagggaaatttataccactaaatgcccgcaagagaaagcaggaaaaatctaacaggggataaatgttattcttagatagaaccctcataagttgtttgagcaagtagaaacaacaataactagaaactgaggcttattttaaaaaaacctacacagccataaaaaagaatgaaatcatgtcctttgcaacaacatggatgtggctgaaggccattactctaagcaaattaatgcaggaacagaagaccaaataccacatgttctcactcatatgtaagaactaaacattgggtagtcatggacataaagatggcaacaataaacactggggactactgggtgggggagggaggaaggtgagtgttgaaaaactattgggtactatgcttactaccttggtgacgggatcagctgtaccctaaacctcagcattaaacaagatacccatgtaacaaacttgcacatataccccctgaatctaaaataaaagtcgaacttgttaaaaaaaatctaaaacatgtaaatgaacatagagctgcagagacataaaataacataacattagataaaaattgtattattgtttcattattgggctttgagagttttaaaaatatattccagatgtaaatcctttatcagatatgtattttgcaaatacttttatcccagtggcttgcatttttgaaacgtggcttgccttttaatatgttaacagtgtcttttgaggagcagaagtgtaaaatgttgatgaagtccaacttatccattctctcttttatggatgatgcttttcatgttctaactaataaatctttgcctaaatcatggtcataaaaattttattctatgttttcttctagaaattttatagatttagattttacatttagctttttaatccacttagagtttaatttttatataaggtgtttgttgaggtttagttctttattttttttttgcaaatagttatccaattcatcaccatttttgaaaagacaatcctttctctactaaattgcctcacacatttgtttttgttttgagacagagtcttgctctgtcacccaggctggagtgcagtggcattgtttcagttcactgcaacctccgcctcccaggttcaagcaatcctcccacctcagcctcccaaatagctgggactacaggtgcctaccaccacatctggctgatttttgtatttttagtagagatggggttttgccttgttggtcaggctggtatcgaactcctggcctcaagtgatctgcctgccttggcctcccaaagtgctgggattacaggtgtgaaccactgcgtctggccacctcacacatttctgaaacacggttgaccaaacaagcatgggtttccttcggggctttctatcctgacttttcctcagtgttggctccattttcaggaagactctttctcatggtttcaaggtgtctgacagtagctcctgaaacctcatttttcagtttcatgctcagtaaaagatgagcatctgtggcttggtattttccacaaaaatcctgaaattgattctaatccagaatgaatttcagtctgattagatcagtttaggtcatgtgatatggtttggatctgtgcgccacccaaatctcatgttcaattgtaatcccaatgttggaggtggggccaagtgtaaggggatgggatcatggggatggtccttcataatcatttagtaccatctccttggtgcttctctcatgagagtgagtgagttattatgagatctggtcatttaaaattgtgtggcaccttcccatcttttctctatatctagccacataagacataccagcttccccttccccttccgccatgattgaatgtttcctgaggtttcccaagaagcagaagctgctatgcttcctgtacagcctgcagaactgtgagccaattaaacttcttttctttataaattagctagtctcaggtattcatttgtagcagtgtgagaatagactaatatatcatgtgatacacagtgattgtcttggacctgggtcacctcctctacctgtgtgactaggaatggagcctcactcaaatcacacagaccttatatgtagaagaatgaattctcaaagaaaaactagggctctgttagaatgggaaaacatatgatgctgtgggcaaaaaacaatgcaaacaaacaatggcaaccaaacatcccaataaatatccatattgctcttaactcaagaatttcatgtgtaacagggaagaactgcatggaagaacacaaattataatagactgttcgaagtataacaacctaaataagtccaagatatcaatgagggagtaattaaatctatctgcatgttctgggaaggcttcccagatatggcctttgaaatgggtttaaaaatctttttaaaaaatacttaagtaaaatataatctatttaaagaaaagtgcacaagctataaggatatggctcaatatattatcacaatgtgaacatgcttgcataaccagcatctcaaaaatgccagtgtcctcttttctcaaaaagtaacttctatgctgagttttaacacagatactagtttttaccactttaaaaacaatataaatggaatcaagaaatatgaatcaacttgtctttgcttattttgtacgtggttatgagattcatccaggtatttgcatgtagccatagtcagttttcattgctgtgtactattccatcatgtgactatactaccatttatttattcattttattgttgtatatttatgttatttccagtgttttgactattatttaaagtgttgctatgaaaaaatttatatttaatttttggctatatgtaaatatagttggacatacatctagaatataaatttctgagtcatagaattagcatatgttcgaatgtagtagatgctgctaaacagttttctaaagtgcttgtgttaatttaaactcccactagaagcataatgggagttctagttcctctacattgctctcagtgcttgatagtgttagtctttttaaaattttagccattctagtgggtatgtagtggcatctgataatgattttatcttgcatttgccaaagactaatgaggttgaacacctttttatctgcctattggcaatttaggtatccttgttttgtgaagtatctgttgtttgttcaagtctttttttcatttttctgtagttttttgttttgatttagaaattattttgtaatctggtatgaatcccttttcatttacatgttgcaattatctcttcccactataaggcttaccttttcactttttttttttttttaaataagagaagggggtcttgctttgtcatctaggccagaatgcagtggtgtgattatagcttactgcaaccttgaactcctgggctcaagcaatcctcccaactcagcctcctgagtagctgggactacaggcatgtgccaccgcacctggctagtttttaatttttatttttgtagagatgggggtcttgctatgtttcctaggctggccttaaactcctggcctcaaacaatactcttgcttcagcctcccaagtagctgggattacaggcgtgagtcaccatgcccggcccttttcacttttgtaatagtgtggtttttttttttaatacacaagtgttcttaatttcaaaagtttaattttaaaattaaaagtttatcagttgtttgctttatgattagtactctgtgtggcttgtccaagaaatcttttcctccttaaagtaatgaagatagatacactccgatgttatcatctggaagcttgttttaccttctgcatctaaacctacataccatttgggatttggttttaggtatgatgtgaagaagggctcaagttttgtttttttaccatgttttatccagttgacccagcaccattttattgaaaagacttatttcttcactgttctgccattttatcataaatcacatgttaatagatgcaaaggtctatttctggactcaattatcttccattgtttgttttcaagccaacaccactttctttttcttttctttctttcttttttttgagtcggaatctcgccctgttgcccaggttagagtgcagtggcacgatctccgctcactgcaacctccgccttttgggttcaagtgattcccctgcttcagcctcccgagtagctgggattacaggcgcacgccaccacgcccagctaatttttgcatttttagtagagacagggtctcaccatgttggccaggctggtctcgaactcctggcctcaggtgatctgcctgcctcggcttcccaaagtgctgggattacaggcatgagccaccatgcccagccaccagtaccactttcttaatgtctatcattgtaataagtcttaatacctggtagagcgtttccttctactttgtcattctctaagattgtcttggctagtcttgactctgcctttacatataaatttaaaaatcggcttctaatttccaaaacaaacaaacagcacaggctgggaatttgactggagttgtattaaatctgtagatcagtttgcagacaattaatattactacagtgctactacagcatggagtcggagtcccccagtccaggaccttcgtttatcccttcatttacttaggtgtttaaacatttttatcaaaaatatcttagagttttccatgaagcagtcttgcacatattttgctagatttactcctggatatttgatttaaaaatatgattatagatggactttttgtttgctaaacatttattgatatatcaaaatacatttgatgattttgtatttattttgatcaactgggttttgaaatcttgctttctcttgggaagtaggttcatccatgtaccctaatatactctgtaggcctcccccgatgcactgcctatgggactcaaggttgccatattgcacaactccgggggcagcaatgacattgtaatccatgtagtcaggagaggcattatttatatacagtagaatatgatttgtgctctatgcattgtgtaaccttgactgccatgtaagaagtatatgagctgggcacggtggctcatgccttcaatcccaggactttgggaggctgaggcaggcggatcacccaaggtcagaagtttgagaccaacctggctaacatggtgaaaccccgtctctactaaaaatacaaaaattagccgggtatggtggtgcacgcctgtaatcccagctacttgggaggctgaggcaggagaatcacttgaactcaggaggcagaggttgcagtgagccaagattgtgccagtgcactccagcctgggaaacagagcgagactccatgtatattaaaaaaaaagaagtatatgaaaggtggcagatattgatagaattatcattcccatgcttggaaaattgtatttctttagtgactagtctatacctcactagaaggaaagactttttcctcttctagcctgttgtctttgagaaacaaaatagcattgccatatgtgagagctcctcctccttctccatagtctaactcctcctatgaatccaattacacttaaatcacctttggggtccaaagccaatgtagttgattcctgacttagcagggaagaatggaaaaccaatattatccaagaaacagggaagtgggaattgatctggatagcgatgttacacacagctgttcagtttgcacgctgcacgaaggctgctggccataagaataaatttggaggaagaaggctgaaatccagtagcactctgcccaccaagctgtgtgccttggcgtggggctgcatctatactcagggagcactttctcctaattcagctacccagatggggtatcgtttcccattttacacaaaggcaccctttaggccagtggatgccctggcccaggcctcgaagtttgactcatctccaagtcgatcatcagtagctgcatttatcagtttctcttggcacagatttgcagcattgccaggatgctgacaaaatgtttctagagaactccacgccctcttctaccctttctgttagtcttttattgattcttctctcttgtgtttctaagcctgagccaggaaccctcctgttattaaaagcagtcccagttgcccacacctttcatttcctttgaattacattaattgcctgacagctaaaaagtgagctggtattttcagatttcagcggctggtcggcaagaaatatttaccagctcctgcagatttataaagatgccatggagatgcctggagactaacaatcagaaaatacagcagcaaaacaacactatttttcaaggttaaatgctcagaatgctaaaaagaaattgtccataaagcaaaatagggattcagaagcaggcagcctctactctggacaaagaaaggagccagaggtttaaaataagatttcacagcttcacaataattatgaatttaataaggggagctttatttttaatttagtttcagtctggcagccagtctcctccctccaaccccctctctgcggcatggtagtgctctttaatgtggtcctaaggctaggtcacagtgagagctgggaagcgcccccagccataagactttctgatgaagaagaatttagacagataatgtttctgactctctgcaggcagatgggactaactcccactggctttactccctcctggcagccagaaatgtcttttgctatgtaggaagacactaggttctgaaaattccaagacaggaagatttttttcctcctggatagaaccctaggctctgattcctgttctccatgaacagaataataaaaccgagccaaggccactaagaatcattttagactctgctggtcaacaccatctccacttacaaagtctcgtttcatagaccacctttcagtatgagccgtttgccaagaccacatacattcctttgtttattgttcattcattctacaaacatttattgaaggtctattttttgaagtaccctgtgttatagaggttaaattcacatgacaaaattgatcattttaaggtgaacaaattagtggcatttagtaccttcacagtgttatatgaccacctctgcctttttccaaaatagcttcatcacccccaaataaaaacctgtacccattaaacagttactcttcatttttctctttccccagaaaggggtactaccaacctgctttctgcatttgtggatatacctattctggatatttcatatacatggaattatacaccttttatgtcttcttacacttataatacttttgaggttcatccccattgtagcatatattagtttcttatggctaagtaatagttaattgtatgtatgtattataccacaatgtatttatccagtcttccatttatggacatttgagctctttccatcttttggctattgtgaatagagctaccaggatcattcatgtacaagtatttgtttgagtactttttaaaaaatttctctgggatatatgcttaggtcatatagtaagatcaaaaatatttcctgatcttattccctttgttaatggaaatagtctcttcatacatctatggtttcttcaagactgtttctccaaggcagggagctagcttcttccttgaataactttgtcttcagctagataggaggagctcaaaagcaaaatgatagttcctagtggtatatatgctagaccaaaagaggagaaattcagtcactgagggttgccacagaatggtaacaatgagattaataataatggtttgcaggaaagacaccatcttgaaaggatgctgtgaggaattcattagataacacctgatagaaatacacaagatgcactttcctctatctccctttccattcttctgtctgcataaatgactgccctgaattcctttgtagagctatgatttaattattcagagtttggtatccacctaatctgtaaaccctactcgagatatttattttcagcacctgggacagagcccagcatatgacagtcactcaggaagcaattgttgaaagaatgaacaaatgttcatctgcttatgttcattgccagacaaaagaatctgcattttacatcatgtctattgtttactggggaggggcctatgtgacattgcctgtgtgaatttgggaaatgctaagacattttatttttggtgtttaatcttatactcccacatgggccacaggactggtccatcttatggaatatgaaaaaaaatgttcacatttcaggttgttcataaatctgcctcctgcattaccatttcttatctgcctacttctgcttcccctgagttcagaggaagtgctttaccttagaaatgattcactactcctgggccatcgtgggctttgaaagccacacaatagaagttccatttcaaatccccccatttataatcatgggagaaagctgggtgttgtcttgggggttatcaatgatttcagaaaactcaacctttgttcctcatgtgtccatttttcaaaaacttacgactccaaatctctggaagtcattgcatctgaggaaacatttatcttgggtttgacatcttttgcactgtatcccttttcaactctcctttctcatgtaggacaaacggcactgtggggtttgaaatgaagagttatgtcttgcagcaagtgcgtgtgtggagatcctgggctcctccctgccccctcccctgtgcccctgggttggaagatgaaggaataatcagcagagacaaatgcttatgagtgaggttatgggttgaattatatctacccaaatttgtatgtggaaattctatcccccagtacctcagaatgtgaccttctttgaaaataggtttcttggggatataattagtgaagatgaggttgtactggagtaggctggggccctaattcaatatgattgttgtcttcattaaaagagggaatttggagacagacgcacacaaaagaactccacatggagattaaggcagaggtctagaagccaagaaatgccccaaattgccaacaaaccaccaaagctatgagagaggcacgggacggattctttctcacagcccacagaaggaaactatccggccgggcgctgtggctcgcgcctgtaatctcagcactttgcgaggccaaggcgggcggatcacctgaggtcagctcaagaccagcctggccaacatggtgaaaccatgtctctactaaaaatacaaaattagccgggcatggtggcacgcacctgtaatcccagctacttgggaggctgaggcaggagaatcgcttgaacctgggaggtggaggttgcagtgagatcacaccattgcactccagcctgggtgacagaatgagactccgtctcaaaaaaaaaaaaaaaaaaaaaaaaaaaggaacctaccctgccagtactttgatctcagactcctagcctctagaactgtgaaacaatacatttctgttgttcaagtcacctaatttgtggtctttgtttttatagaagtcctaggaaactaatataggtgatactctcacgatgtttgtctaaaggtctctatttacttgagaggtgatatagcatagtggttaaatacttgggtttttagaaccagacacccaggcggataatctgggaaaattactcatcatctctaggcttccaatttccttaaaataagatagagaatataataaatctagacctgatagtactgtcatgacgattaaatgagataatgtatttaaagcactaagccaaagaaatacctggcacatagtaaacacgtgatgggtggtggttattataatggttattattagtaatgaatggcaacatttactgttgccctaaagccccaaagaatcctttactatctatattttaaactttcttcccagagcacacttaagaaatgattgacattttcccttccctctgacccctgctctctaggttaatggtctgaggctctgttccatctttgtccctttccagagatttaatctctctctctctctccctctctctctctctctctctctgtgacatgggacttatatgattgacacacaggaccacccacttatcatttacactagtggaagtaagatggttccaaaagctgggtgaggatttgaagtgaccagaatagttgccaggatcatgtattctttcatatacaaaaaacacatttgttgaaagccagtggtctaggtgtaggatctgatttagtgtgggttatttgtcaatgtgggcaggggaagggatgcagcataataattccataataactaccacttactgaaatgtatgtcaagtgccaggctaaattgtctcagcacaattatcctttaaaattctacaaggttagatagtcctgtcatacccattttatagatgaggaaatggaagcatggagcgattaaggccatagctggttaaagagcagaatcagaagttgaacacattccacagactctagagctcacacttttaactcctgtgagtcactgcctcagcggcaccaggaatccgctgctctcaggtgtatatttgaaaaagattgtgaacaagacagaggaaacctggttacagaattaaatgccagcatgtaaagcaaacatacaatcaaaaccaagctaatgaaaaaacaaaacaaaaccgaatccccaaaacccagaatacaaaaacctgccatgtgttggttactggaggaaaataagtgttttcctaatgtttaaactcagcaactgaccctaagacttgttttaattttgcgattgttttgaagctgctagtctgccaggcatatggtgcaggtaagctttgccaagtcgttcctccgaagcattttattacgataataatcacaaatgtgacctcagtccttttatcctgtttattctctaccgtttcctgtgataagtgctacttctgtactttgccaacctcctccacccgcatttgtttagggaaagaatattaattagtgatattaaggaggctatgggctgaaaatgaaattttcataatggaattccttagactatctttgccctccgaggcatcctctgtttaagcagttcaattgaatatcattattaacatacataataataataattagcattattgcctgcatcagttgttgttcatggaaaactgcaagctcttttctatctattggcctcagttaaaagtgcgaaatagattctcattttatgttttatttccctgtcatttttgctctgctcaactcctatgcttggcagctggaccccttatgaggtccttattggattttttttttttttggaaaaataaagaagtttctttattctcctgtttgaaagaggagtctgtcagaggtggaaaaccttcaataggccaacttttttaatttttaatttttaaagtttttttagaggcagcgtcttgctctgacatccaggctggagtgcattggtactatcatggctcactgctgcctcagacttctgggttcaagcgagcctcctgccttaggccaactttcctgagttgtcttgaagctttatttgtgcaccgtaagccactcaagattttctgcaaaacctctcctggtttctagcatctctctctcccaatccattatctggatacactgagaatcatgtttctaaaaagcaagtctggctttccacctcctttgctgaaaaaccttgataggcttcccattgcgctcaggataaaatccagatttcttatcatgtcttaatgccatgacccttatttcctcatctggctttatctctcctcactccatctccttctgcagtctgatcgtattaaacttgttttggttttgcagagagactgtgccacctcacctcaagctatagcatgtgctgtaaatgaaatgccctctcctccctgattcaggcttcagtgtgggcaccgagtcctaggagctttcctatcttctcaggtccaagggtggtgcctaatgttaatttcagggaggtataagactgcatacgatacgcgcttcttccccaagcactggtaaatgaatggctttgaatattttacatataggtcatagtatgcttctgtttctccccttcttggctgtttggcttagaatagggggcaacaaactttggtctgtgtgccaaaagcaatcagccacctgtttttttaaaacattttttaaaattgagagaaaattcacacaacgtaaagttaaccatttaaaaacatacaattcagtggcatttaggacattcacttttttttttttgagacaattcgactctgtcgcccagattggaatgcagtaatgtgatctcggctcactacagcctcgacatcctgggctcaagcgatcctcccaccttagcctcctgagtagctgggcctataggcatgtgtcaccactcccaactaatttttgtattattaatttatattttattttattttattttattttgaacaaaggtggattgtctccaccttttagtagagtattttgtagagtcagggttttaccatgtggcccaggctggtcttgaactcctgggctcaagcaatccacctgcttcggcctcccaaaatgctgggattgtaggtgtgcgccaccatgcctggccacatttccaatattctgtaaccatcacatctgcttagttccagaacattttcatcactccaaaaagaaagcccataactgttgagcaggtgttctcaattttcttctcctcagtcctcggcaaccaccaagctaccttctgtgtctgtggatttgcctattctggacaatttatatcaatggagagtcatgcattgcatggtcttttattcatttatttattttttgagacggagtctcgctccgtcgcccaggctggagtgcagtggtgcgatctcggctcactgcaacctctgcctcctgggttaagtgattctcctgccttagcctccccagtagtggggattacaggcatgcgccaccacacctagctaatttttgtatttttagtagaggcagggttttgccatgttggtcaggctggtcttgaactcctgacctcaggtgatccacccgactcaacctcccaaagggctgggatcacaggcgtgagccaccatgcccggcctacgttgccttttgtgtctgcttctttcatttagcatattgttctccaggtttatccacctggcagtatgcgtccatacttcctattcatggctgattactattccattggatgcatatgccacattttgtgcatccatttttcagttgattgatctttggattgtctgcaccttttagctactataaatagggctgctgtgaacatttgtgtacaagtttttgtttgaactcctatttgtaattattttcggcccatgcctaagaggggagttgccgggtcatatggcaattctgtgtttaacccttttaggagccaccaaacccagtgcctgttgttgtaaataaagttttattggcacacggtcaaggccattcatttacttctcgtctatgactgcttctgtgcgacaacggcagagtcaagtagttgcaacatacgccatctgcccctaaagcctcaaagattaatttttatggagttttacagaagtttgctgaactttaacttagtacacctgtgttaagcaatgtagcctgcaggccttgaagccagtaacagcactttttcaacaaagatggggtgaatacagaaaaaaaagtttattctccttaacctgacttatacattcctgatactttagaatattttatgtagatctgaggagcctattttgaatatcaaagggtgaggtcaagtcttgtgggaaaagtggtctggaaaattgcctagactctggagtcagactttgtaggttaagtcacgaaacctctctgggcctctgttttctcatcctttaaatggagatgattaggctccccatcttgtaggacggtagagaggattaaatgaaggaaacactggcgaactgcttataatggtgcctggcataaatattaactcttactaggtgaggctcagagatcgcccaggacaaagaaagaaaatggatcaatgagctagtttatctcatgcctttggataaaatactctacacccctcctcttaaaattgtttttgtactgcgatttttatttttgaggtaggatctcactctgtcgcccaggctggagtgcagaggtacttggctcactgccacctctgcctcccatgctccagcaatcctctcacttcaaactcctgagtagctgagagtagcatacatttagcgaattgttttatttttctgtagagacaggtctcactgtgttgcctgggctgggtagcatgattaaaaaaatttttttttgagacagagtctctcgctgtgttgtcccggttggagtgcagtggtacaatctcagctcactgtaacctctgcctcctaggttcaagcaattctcgtgcttcatcctcctgaatagctgggactacaggtgtgcaccaccacatctgactagctttttaaaagatttttagtagagatggggttttgttatgttggtcaggctggtcttgaactcctggccttaaatgacccatctgtcttgacctcccaaacctcccaaagtgctgggattacaggcatgagccactgtgtccagcctgggatagtgtgatttttttttttaatcgtgataaaaatatagggtaatataaaacttaccattttaacctttttttttttttttttttttgagatggagtctcactctgttgccaggctggagtgcagtggtgccatcttgactcactgcaaactccacctcccggtttcaagcgattctcctgcctcagcctcctgagtagcttggattacaggcatgcgccaccatgcccagctaatttttgtatttttagtagagacggggtttcagcatgttggccaggatggtcacaatctcctgacctcatgatccgtccacctcggcctcccaaagtgctggcattacaggcgtgagccactgcgccaggcccattttaaccattttgaagtgtacaattttaagtgtacaattaagtggcattaagtacattcacattgttgggcaaccatcaccaccatccatcttcagacgcttctcatcatctcaaactgaaactctgtccttattaaacaccaattccctatgcctccatttccccatccctgggcaaccactgttctattctctttctctatgaattcagctgctctagatacctcatataagtggaatcatatgatatttgtctttttgtaactggcttatttcactcagcataatatctttaagtttcatccatgttgtaacatgtttcagaatttcttccttttttaaaacacatttttattgtggtaaaacacaaataatataatatttaccattggaaccacttttaagcgtacagttcagtggtattaagtgcattcatattgttgggcaaccatcaccaccatccatctccagaatatttttgtcttagaaaaatgaaatgcaggctgggcatggcggctcatgcctataatctcagcattttgggaggccgaggtgggcagatcacctgagattggaagtttgagaccagcctgaccaacatggagaaaccctgtctctattaaaaataaaaaattagccggctgtggtggcgcatgcctgtaatcccagctactcaggaggctgaggcaggagaatcacttgaactcgggaggtggaggttgtggtgagccgagattgtaccacagcatgggcaacaagagtgaaactccatctcaaaaataataataataataaaatcaaataaaataaaatgcagctgggcacagtggctcatgcctttaatccttgcactttgggaggctgaggcaggaggatcacttgagaccaggaatttgagatcagcctgagcagcatgttgagaatctgtttccaccaagaaaaaaaaaaaaaaattagccaggtgtggtggcacgtgcctgggaacacagagatgaatgcagttggagtggagcaagacaggagaatggtctgagatggtgaagagacacgtgaggccaggctgtgctgacctggtgagatcctgggagaagagtttgcacttcattcctagtgcgatcagaagccaggggagggttggccacaggagagtgacatgatcatcttcactgattgctgttgaaaaagacggttctactctttgaccactggctttgtaaagaggttttcaaggctcagagatggcttgtattgttatattaggagaggtttgatggtagccgacctggtagtggatgttctgtttcaggtgccataaatggggccatacatcaaacccattgattttctacttcagagaccccaagagccatacaaccctaaccctcagtgcccctgcgtaaagttagacagacatcgtttattggggttacagagcagctgtctaaatcctgcctggactcatttaaagcagtgtgcctcgggggcaccttgctcctgcaaacatttcagagccaggaaagactgactggggatgaaggatgcacctgacttcttggcacctgctgctgcatttttgttttgattgtttgcatgatgcttggaggagaagcagggaaaaaagaggccgataggcgtttttctctcacttattgttcttttttctggccttggaaggatggaaggaaggaaggaaggagggaaggaaggaagctaatatctattgaacagcaatgcagggactggatagttatggtcccaagttacctaatttcattcattcattcattcattcattcattccacaagaaatattcattgagtgtctttatatgccagacattgttctgggccccaggaataagcattgaacacaatggacaaagcctcttctctcttggggctgactttctgacaaggaagacaagacagacattaaacaggtaagtacaaatcaggcggatatgtcctaggaggaaaaaccaagctgagtaatgagatggagagagtgtggactattttatgtgggagggggacactggtcagggaagctctctttgcaaaagtggtatctgagcagagaactaaagaaaataagggagagaagcaccagactttctgtggatctaggacattgttatttcttcttagagaagagtctactgagaattggaggaattaagtgactcttccaagatcagaagatagtggtagcagtagcagcagcagtagtagtaatagataaattttattacatttgctctatgccaggcactagatgaaatatttatttctatcatctcatttaattttcacaacaaatctacaaggtagatatcattattgttattcccattatataaatgccaccgaggatcatagaagtgatatcacttagctaaggtcacacagctaataaaggagaagcagagattcaaatccacgttcattagtctccaggacactataaccattttccagcccatagctgatgaagctgaaatacagagtgaagcctctatctgaaaacccttcttttccaatagaccagtccaaatcccaactttcaatgcagtacccggttctttgattagaccctggcatagggtttgttaggtgggtattgagggcctcctaaataatggagtagtgcatttggatctgtgaccacagacattttgagtcccaccatctctgatttgcacagagaccttcttgtgaccaattattgtgagtcaagagctcaggtgtccaatgaaagttcgcagggagctactcttctcttgaaagaaatgggctatagagctctattggcctgggatgtgcagctccattggtccatgatttgatgagaaagactgcaaacgtgtgatccagatatatggatgtgtatatgcctcttagcaagaatgcagttgattttctaggtctatggagctatgcacacagctatagcattcatttactcactcattctgtgctgtgcctgctagtgtgttacattctgagtctgcagcaatgaacaggcaaggtccctgtcttcctgttgaatacattataaggggagaatgagggagtgttgtgtgaagaaggagaaaataaagcggatgaataaatgaacaagatcatctcagatgctgagagtgccctgaggcattgccacagagagacactgggatgtctgcttatattgagtggtcagtggaggcccctctgagcagggccaattgaacagaaggggagggaggagctgccatgagcagttctgcagaaaagcatttcaggtgccagaaacatcccggtaacagacagaagactgggtcaaggggtacgtgccttaaggactgtgataattaggtgggtacacaaagtattttgctgagacttgcaaaaaggaaaccagagggaatgccagcatgaaaaacatgagatttcaagtctgtaactgctaaaagtcacagactctttataacttatgagctctttataacttatgggccgcaggagaacctttgaagaatgtggttcaagagaaggattagctagcagagaagattttaagaaatatgtcttaaaaataattttatgatgggaaattccaaaggtatatgaaagtagaagaatagcacaatgaattctcaggactcactacctggcttcaacaatggacaactcatgcccagttttgcttatacctctacctgttttccccacatacattattttgaagccaattccagtcactaccatttcatctgtaaatattacaatgtgtatcttgaaaagataaactcttaaaaacataggcacaataccatcagtgcacccaaaacattaacaatgattccttagaacatcaactatccagtcaccgttcaggttacttactgcctaatacaattttttctttcttttttatttttattttactttaagttcttgggtacatgtgcagaatgtgcgggtttgttacgtaggtatgcaagtgtcgtggtggtttgctgcacctatcaacccgtcatctaggttttaagcccagcatgcattagatatttgtcctaatgctctccctccccttgacccccaccccccaacaggccccggtatgtgatgttcccctccctgcgtccatgtgttttcattgttcaactcccacttatgagtgagaatatgtggtgtttggttttctgttcctgtgttagtttgctgagaatgatggtttccagcttcatccatgtccctgcaaaggacacgaactcattcttttttatgtctgcatagtatttcatagtgtatatgtgccacattttctttaactagtctatcattgatgggcatttaggttggttccaagtctttgctattgtaaatagtgctgcagtaagctctctcacccaggctgaagtgcagtggcacaatctcggctcactgcaacctctttcccctgggttcaagtcattctcgtgcctcagcctccccagtagctgggattacaggtgcatgccgccacacctggctagtctagtttttgtatttttagtaaagacaaggttttgccatatggtcaggatggtcttgaactcttggcctcaagtgatctgccgcccgccttggcctcccaaagtgctgggattacaggcataagccaccactcccggctctgcctaatacattttaataataatttctttgaatcagaatccaactaaagtcctacacatagtgattggctcatgtgtcttttaatctataggtttccccttcagttcttttattgctggaaaaataggttattcatcttgtgtaattcaaaatgtggtcagtgaaccaggatcatcagcatcacctgggaactcggtagaaatgcagcatctcagatcccatcccagacctcctgggttagaaactacattttcacaaggtccctgggtgttttgtatgcacaattaagtttgagaagcactgctgtagagtcccccgcagtctagacattgccagttgcatctctgtggtgtcctttagtgcattccttcatcttccacttttctttcttttctttctttctttttctttctttctttctttttctcttccttcctttctgtctttctttctttcattcctccctccctccctcccttccttccttccctccttccttctttcttttccttccttccttccttccctccctccctcccctaccctccctccctccctccctccctcccttccttccttccttccttccttccttccttccttccttccttccttccttccttttttcctctctctttctttcttttttgtttgagttggagtctcactctgtcacccatgctggagtgcaatggtgtgatcttcggctcactgcaaccgctgcctcccgggttcaagcaattctcctgcctcagcctcccaagtagctgggattacaggcacccaccaccacgccccgctaatttttgtatttttagtagagacggggtttcaccttattggccaggctggtctcttagccaagctggtttcaaactcctgaccttgtgatccacccacctcagcctcccgaagtgctgggattacaggtgggagccaccgtgcctggcccattgtccacatttctgtaagttgataagttgtatctatacatttttatcagatttaggtctgattttttcttttttttttttttttttttttagcaagaccactttttagattgttatgtttttccatgaggaggtaactgatgtctggttatctcccattgtgtttttattttttaaaattatttttattatttatttatttaatttttgagatggtgtcttgctcagttgcccaggctggagtgcagtggcatgatcatggctcactgcagctttgaccttgcaggctcaagtagtcatcttacctcagcctcctgagtagctggcaccacaggcatgcactaacatacccggttagttttttacaaaactaatttgtagtgatggggtctcactgtgttgcctaggctggtctggaactcctgggctcaagtgatcctcccactttggcctcctaatttgctgggactacaggcatgagctaccatgcccagcctcatttgtgatgttatctatctgctgtatgataatgcctagatccatgaattcattaagggttgcaaaacagagcaaggctttgacttgagtggatccagtttattttggaagtgattaattctctaatttttattcaccatttctataaaattaatggtatattgcaccaattatgtgccaggaactgttctaagggctttacataaatgaatgcatttattgatcctcacaaaaatctttaaaactgtgtattcatttcctattgctgctgtaacaaattgccacaaacttagtggcttggaacaatccaaattattatcttacagtgttggaggtcagaagtcccaaagaggtctcacttggttaatatcaaggcattgacagggctgcattatttctggaggctctggggagaacctttgcctcttccaaattctagagaccacctgcagtccttggcttgtggcctctttctccatattcagagctactagcataacatctttaaatctctctctgattctcttcttcctccctcttccacacttaaggacccttttgattacatcggttctacctgcacaacctcctggttttaaggtcaacattgattccatctgcaactttgattcccttttgctgtagaatctaacatattcataggttccaggaattaggacacagacatctctgaagggacattattctgccagccaccactaggctctttggttcctgttttacagacaaggaaactgagatacatcgaggggaaataactcatccaaattcacacaggtcctaactggtggagcttggatacaaacagagagagtctggctccagagtccatgctttgaacccagcagatgtgagatcacttagtgctcaacactgaatttcctctgagacctcgatcttgccaatgaacatatgtttttaggaacattgaatcctgcggttgtcaggggatttctgcacacaaatgttagccggtgaattcaccgttctttccgatggtaagttagtgtttccctcctaaaaggtggtaacagtgggcttgtccttggttcagtctgtttcttcttaggcccagtcagttacccactgaattaaccccacgctggaccctgacctctttttggtaccatgtacccttttggcatctggcggagtctatgacctccttctgagaacaatatccttttttttttttttttttttttggagaagatatgtttattaatggatgattacattagctttctgggcaacaaacctaaatatgcctactaatattgatcttctattcaactcaaactgaataacataacttgttctcaatataacttactttttttaaagtattattgcatgcccttattttatttaaactgagatcttcttggtgtcagacgtttatctcaacctataggtaaatatgtttacaattataaatctgctagtaaacatattatataacttcttctacttagtaatcttcatattagacaactatagcttaagtatcatcatactagttatactcaaattttccctattgccttaaagattccctttggcagtttgtttgtttaaattaaggcccaaaattcacatatttccttttttatatatataaatctttctaactccaaaacaatatttaaccattagcactttttatttttggtccattcagttttgggaaaatgttatttaggctatgaaatattctatactagatttgattgattgttctttgtaatattgtttaaattatttatctatgcaaaaaataaagtgcatggaattacaaaggaaaccaattatactaaaatatggttatcaaaatataaaaaaactcaccaaatttgtgtcatagtaatatgtgaatctttactaatgcatcaaataacaagatttagtggtgagtctaataactatgtaattccaattagtgatgcacacgtacaatataatgagatgtctgctatgattgtaatgagatatgaaaatatcgtgatttatatcggtgacaaaaatcacagatattgcaaatactactgtggtttgttgcttccatttataatagaaggaaatgctaaattttagttagcaatcagagaaaatgaggcaggtttatggaccctctgaattctacccacaaacctcaagttgggagccctggcctagtaccccattggtttgtgctgcttatttagtatttctctctctctctctctctcttttttttttttttttttggagacaaagtctcactctgtcacccaggctgaagtgcagtggcacgatcagagctggctgcaacctctgcttcccgggctcaagcaatcctcccacctcagcccactaagtggcagggactacaggcatgagtcaccacgcccaactaatttttgtaattttttgtagagatggggtttcaccatgttgcccaggctagtctcaaactcctgagctcaagcagtccacccgcctcagcctctcaaagtgctaggattccaggtgtgagccactgcaccgggcctgtttcgtgtttctcttaatttgatagactctagcaaatacctgttgagaccccactgtgggcaaggcatgtgctagggacttgggagagagcactgaacacacagagctggccttcaaggaacagatagatttcttttaagattttcccgccttccttctggggggagagtgtcttcacccttcagtgtaattgcaaactccttgaaggctgggagtggttctaagtcccttctcttgtcaggcctcagatgataggcattgaagaaacaggaggttcaaagatcaatgtttacacaaaacgattttcggtcgttcatggaaaaaaacattttattatttaacagttaaacatttatgttaatgcagataagaaaatatatagaactcagctgggtgtgatggctcacacctgtaatcttagcactttgggaggccgaggtgggagaattgcttgagtccaggtgttccggaccagcctgggcaatatagcaagaccctatctcttaaaaaaataaaagaaaacatatagaactagccatcttaatacataatatgggttattattgcctaggatgaggacttttcttctttttataactgtgctgaaaaggacatgacattgtacttaccatcttcaccattttataatgtacagttcagttgtgttaagtgtattcacgttgtgcaatagatctgtagaagtatttcatcttgcaaaacggaaactctagacccattaaacactaaatacctccagcccttggcaaccgtgattctactttctgtttctaggagtttgactacttgagatacctcattggagtggaattgttcggtatttgtccttttgtgactggcttatcacataaagtcgtcgaggtttgtctatggtgcagcaccccacaagatttccctctctctctcttttttttttttttttttttaaagacagggtctcacgctgtcacccaggctggagtgcagtggcatcatctcggttcactgcaacttctgctccctcgactcaagtgatactcccacctcagcctcctgagtagctggtactataggcacacaccaccatgcctggctttttttttttttttggcatttggcagtttgtttgtacattgaaatacaagatctctgaagcttttgtagctataaatgtttctaaatgatgcaacacatggtctcgccatgttgcccaggctggtctcaaactcctgagctccagcaattggcccgcctcagcctcccaaagtgctgggattacaggcgtgagccactgtgcctggccaaatatccctctttttaaaggctgaataacattccatcgtacgtagatatcagattttcgttatcccttcatttgccaatgggcatttgggttgctttcacctcttgattattgtgaataaccctgcaatgaacatgggtgtgcaaatatttctttgaaatcctgctttcaaatttttgggatatatacccagaaatggaatttctggatcatatggtatttctatttttaactttttgaggagtttccataccgttttcctgtagcaactgcaccattttcattcccaccaactgtgcacaaaagttccaattcttcacgtcctcgccaacacttgttattttctgtttttttttttaattgtggccatcataatgggtgtgaggtgatatgagatgaggatatttcaagataatattaagtaaataatagtagaggtgttcaatagaaatggcaaaaatgaagatgtaccaatgcatgaagtttggaaacctcttttttttttttttttggacagtctctgtcactcaggctggagtgcagtggcacgatcttggctcactgcaacctctgcctcccaggttcaagcgattctccagcctcccaagtagctgggattacggacacctgccaccatgtccagctaatttttgcatttttagtagagatgtggtttcacattgttggccaggctggtctcgaactcctgacctcaagtgatctgcccgcctcggcctcccaaaagtgatgggattagaggtgtgagctatcatgcccaacctggaaaactcttgatcagacaacttctaaagctgcccaaagtgtggtctgtggtcagtaatggcctgagaactgttccttgtctgagaccagataagacagaacttgagggtacctgtttagaaggatagcaatttaacattcctaaaacatctgaatgcatgatcgttattctagtaatttgcttttattgtattttatgaacgtattggcccacgatggattggcaaacaaaagaagacaaagcaaagctggccctgcagccctgacagtctgagaagctctacagttccgcccaggcttggcaacataactactgaacttattttggcctcagattttccatctataaaatgaggataagaaaaggaaagctcagtcttcattttattttatttttgagacagagtctggctctgttgctcagggtggatcatgcagtggcgcgatcttggctcactaccacctccacctcctgggttcaagcgattctcgtgcctcagcctcctgagtagctgggattacagtcttgtgccaccatgcccggctaatttttgcacttttagtagagatgtggtttcaccatgttggccaggctggtcttgaactcctgacctcaagtgatccgcccacctggagctcccaaagtgctgggattacaggcgtgagccactgtgcccggccgggagcccagtcttgatcgttgtcagctagtagctggcctggtactactgctaggctgtggtgttccctacttaagcaatttcataggatggtcacactggaagatgtcatgctgaccatgatgaaacaagacaaaaacaagacagtctgtaatgaatcctatctgagcatgaaagtatgagcagtgggcaaaccacaaaaaaatggccaaacgcatcctctccttctgactgacacatgcagttactgctggttttccaatgacagctttagccccactctattcctcctgcctcctacataaaaattatgatgatgcccagccatggaattaacactgctttctgccagctaaccagaagcgccccaacacactcttactgggacacagctcccactccccatggtgtgtggtcttccttgttgcaacaggttactaaacccatttctgttcaactacaggtgtgtttctggtggcttctggctgatgagcatgacaggaataataatagatggctataggtttaaatgagttcatgcatgcaatatgcttagaatgatgcctggctccaagtaaggtctattaaaatgttagatattattattattgttattattattcggaatagcgtcttgctgtgttgcccaggctggagtgcagtggtgtgatcatggctcactgtagcctcaacctcctggggtcaagcaatcctcccactttagcctcctgagtaggtgggagtacaggtgtgaggcaccattacaggcctattattattaataatattatctttgtccctcacagtgatgggcaccacatcttgccatagaaagaccccatacttgctgggcacattggctcatgcctgtaattccagcgtgtttagaggcctaggcgggagtattacttgagcccaggaggttgagaccaacctgggcaacacaatgagatctagtctctacaaaaattaaaaaatcagccagctgcggtggtgcaaatctgtggtcccagctactggggagggtgaggtgggaagattgcttgagcccaggaagttgaggtttcagtgagctgtaactgtgccactacactccagtctgtgtgacagagcgagaccctgtctcaaaaaattgaaagacacaccccacacttgtggggacaccaaatttgtggattgatttgggatagtgtattcatcatctattgttgtgtaaaaagttaccccaaatgcagtagctgaaaacaataaatacctattatctcacagcttctacgggtcaggaacccaggagcagcttagctgggtggttctgactcaggatctctcatgaggctgcaagtcaggctgttggctagagctgctgtcacactgggactcaaccagaggagactctgctccgaagttccttcacatgggggctgtgcctccccatgcgaacctcgccattgatggcctgaatgtctctgcaacatggcagctggttcccgagagagagagagagagagagagagagagagagggagagagcaagcacaaccctattctattcatgatgcagactagccctggtctgtgcatggtgggggatgccacacaaggggatgaatacctggaggcaagaataattgggaccatcttgcaggttgggccatagagggcctccctgttcctccaagtgccctccaacttttccctcttggcttcaacttttttttttgtttgtttgtttgtttttgagacagagtctcactctgtcacccaggctgcagtgcagtggtgtgatctcggctcactgcaacttccacctcccgagatcaagggattctcctgcctcagcctcccgagtagctgggactacaggcgcccgccacaccatgttgggctaattttttgtatttttaatagagatggggtttcaccgtgttagccaggatggtctcgatctcctgaccttgtgatctgcccacctcagcctcccaaagttttgagattacaggcatgagccaccgcacccagccgggcttcaactttaatttagaccaagaagacatctccattctctctgaatggagcttgaagacaaacaaacaagaaatgagtgtgagtatagctggggtgggatggggcctacaggtattggagaggcagaaatctcgtcctgtctgttgacatttgtcaaggcctctgcagggacaggctcctgggagactctgcagtcagctgcacttccagagggagaagaggcatacgctttctctctctctctctcctcttttcttcctctctccctcctccctgcagcaagagtcttgaatccctctgactgacagtgtcagattgtcttatcaaaacacgggtccgggactacactgtgattggctgtgcagaaccattgtggggctggagaattcttctccgagggaaatgattataaggcattttaagaacagcaagctgaatgctacgcacagctggcagttcttgtttttgacaagtaataattgcctcaggtgcaatggaaagtgggggtggggggctctgtgagtttattttgagaggaggctcagtgcacaggggttgggcattggacaaggaggggtgagtgggagcaacttggctcagggggtctcagactgactcgatctgaggctgagggagcatctggggtggccctgagtgacagtatgtttccttctgtgcccctgggaacacctcttgccatctgagtggggagacagggggtgacttgtgattgtaggaaggcccagatgttctgagcaaactgacccaaagcagcatctgtcctgcatgggggcctggccctgtgagggtgatgcacgagcggcttttgtgcttagagagccctggaaccactgtatgccttgctagacacttgctactcaaagtgtagtgcctgggccagcagcatcagcaccagcctgggagctcataagaaaagcagaggctcaggtccccctcagggacctacagaatccaaatctgcattttgatttttgtttttgtcttttgttttgaatttttttttttttgaggcagggtttcactctgtcatccaggctggaattctggggtgcaatcatggcgcactgcaacctcgaactcctgggctcaagcaatcctcccacgtcagcctcccgagctgacatgcctagctaattttttttttttgagacgaagtttcactcttgttggccgggctggagtgcaatggcatgatcttggctcactgcaacctctgcctcccaggttcaagctattctcatgcctcagcctccagagtagctgggattacaggcctgtgccactgtgcccggcgaattgttgtatttttagtagagagggggtttcaccatgttggccaggctggtctcgaactcctacctcacgtgatccactcgcctctgcctcccaaagtgttgggattacaggcatgagccactgcacccattatatatttttttaagcttcaaaaaagaaaatgggcactgccatggaaaggagaagctggattgtatgccaggcagtcaaaaagccaactgtttttgatgattggagtgctggttacagagggagctcattttcttttttaaaaatatatttaaaaatgttttataaggccgagatgggcagatcacctgaggtcaggagttttagaccattctggccaacatagtgaaaccctgtctctgccaaaaatacaaaaattagctgggcgtggtggcaggtgcctgtaatcccagctactcgggaggctgagccaggagaatcgctggaacccgggaggcagaggttgcagtgagccgaggtcgtaccactgcactccagcctgggcaacagagtgagactgtctcaaaaaaaaaaaaaattatagatttagggggtacaagcgaagatttcttacatgcctattctgggattttagggtaaacatcacccgaatagtgaacattgtatccaataggtaatttttcacttctcattcccctcccgctctcctaccttttggagtctccagtgtctagtctattattccgctctatatgtccatgtgtaccctttgtttggggctcattttcttttctttttaaataaccttcatttaaaaaaagttaatatgtgcattatcggaaactgaaaaacacaagaagcaaagaacaaaatcatctacaatcacaagcagtggaactcatctttttttttgtttttttttttttgttttttttttttgagatggagtctcactctgttgcccaggctggagtgcagtggtgtgatcttggctcactgcaacctctgcctccctggttcatgccattctcctggctcagcctcccgagtagctgggattacaagtgcccaccactatgcccaactaatttttgtatttttagtagacactgggtttcaccatgttggccaggctggtctcaaactcctgacctcaagtgatccgcctgcctcggccttccaaagtgccagattacaggcgcaagccaccgtgcctggcccagaacacattctctttatgtgattttgtgtcaatgtggagagatattcaacaaggacatggagtctgtcagactttgcattgccccatttcctgtatactagtttgatgcttgctctatgcagatgtcttggctcatgaaggcccatgtacattctggaagacggtcatggagccagggaccaagtcctgtggctgagaggataaaggactctgtcccagtctggaactgatcacctcagagtaacatgatggggtagtccatggactttcacgtcagaccaagctgggtgtaaagccaggagctgccactcagcagctgtgtcacctcagggaggatgctgtgccctccccttcccccagagaatggcctctgcccggcctgccttggtgagcacaggagctcatggattaagatgtgtaacatgctcagcatggggcttggcacattacagtcagtgctgaataaaggctaggcattaatatgatgttgataaattgttttattttatatgatttaaagataagctttgaggtgatgccgggggagagcgtggatgggaaatttgatagtttcaggagtttgaagaaggcacttctagaagagattggtgatgaaaacagcaaggtctacagagctcttatggaggtttctttttctttctttcttctttttttttaactgagatggagtctcgctgtgtcgcccaggctggagtgcagtggcgtgatctcggctcactgcaacctttgccacccaggttcaagcgattctcgtgccactgcctcccaagtagctgggactacaggcgcacgccatcatgccggctaatttttttgtatttttagtagagacggggtttcgccatgttggccaggctagtctcgagctcctgacctcatgtgatccacctgcctcagcctcctaaagtgctgggattacaggcgtgagccaccatgccccacctccttatgaggtttctatgtggttcttcactgagttccaggacactcttccctggccagcagtaaatcaggaagacagcagtccttagagctgaggtggtaacacaggatgtttgcaaaagggttgaatatttcaggagaaaatagctaatcttgtctttaaaaaaatcagccaattaaccaacaaaccatgtgacctcagataaatattgtttcctatccagctcaatttcctcatctctaaaatgagagagtgtatcctttattccctccatgccaggaactaactgagaagtagagctagctatttgataatcatcaaactaagagctttcttctggtgcacctgcgctggagaacacccacataaaacgatagtaactgtgacgtgccgtgaagaaaatgtgctgtgacaaccagagcagatctgagtgggacagggagctcaagatataacatttaagctctgatctgaagaagtagctggaggtgagtgcattcagcatatgcaaagatcctgtggcaggctggaggaactgaaagaaagtcaatgtggctggagggagagcaggtgcaaaccctcctacatcaaaccttgtgagccctatgaaagattgcacatgttgtccaaagattgaagggttttaaacaggatgttaatattagcatattagcaggagctcactctggcagcagggtggagaggggatggatctctccttttttggaaaggatcacattgtaacccttctcttgccaaattctctttccctcatatgggctgcttttgtttgtgagatgaagagcaagaacagagtagtggtagatgagggctgctagcagctctaccagaatggcaggacatttgagagctgaatggagaatgggtgtaattaaaagaaaaaaggtggaaagacctggcttgatttctcttgccaggaatgattgtactacacattcccgctttaacaccgattttctgtgaaaggtatattagtccctaggctgagttctccgcccaggggcggtacaagaatgtgagaagcaaatactctctccaggagataaaattctaggggactttttatgttatgtctcaggtcccttgacatgaattggctttgtccagccgtcagacaaaaacccaatgcaactgttaatttgtggtggccttggatgatgggtgaaagtattagtctgtagcttaaaacctcaacagcgtgtccttcctcctccaaagtggtaattaaacacggtcagatgtgactcttgccaggctgtttagttgtgctgggcaaggtctctgaattagagatgatgactgtaaaatgtttgtgggttgaaagtcctctcttgggtatacagaaaagatatagagagagtagagaattgtgttctagttatgagtcattcatccaacaaatatttattgagcattgtcccggatacgattggtttcccacctggatcccacttaggagtctaaggcagctgccagggaattgtgctcagctgatggtgctgaggaatgcctgggaggttacattttgcaccctccccaggggcagccccctgccaatggagaggccatatgtaaagctggccccttgatacaggctggataattctgtgatggcttcatgccccagagctccttgtggagttggtctgagaataggctcctgctgaatctatatactttccttttctatctcacttccctcactccctttctcctgagggtgtcagaagtattcaaacgagagtgactccatcttaatatgagctgggtgaaatgaagctgagatttgctgggccgcattcccaggaagttaggtatccttagtcacaggaagaggttggaggtcagcaggacaagatacaagtcataaagaccctgccgatggccgggcgctgcggcttccacctgtaatcccagcactttgggaggctgaggtgggtgtatcacctgaggtcagcaggtcaagaccagctagttcaatactagcgtgaccaacatggtgaaaccccatctctactaaaaatacaaaaatcagctgggcgtggtggcgagcgcctgtaatcccagctctttgggaggctgaggcaagagaatcacttgaacgagggaggcggaggttgcagtgagcagagatcatgccactgcactccagcccgggcgacagagtgagactctgtctcaaaaataaataaataaaagaccctgctgataaaacgggattcaataaagaagccagtcaaaacccacccaaaccaacatggtgacgatagtgacctcttgttatccttgctgctaattatatgctaattataatgcattagcatgctaaaagacactcccactagtgccatgacagtttacaaatgccatggcaacgtccagaaattaccctatatgctctaagaggaagaggaaccctcagttccaggaattcctggcccctttcctagcaaactcatgaataatccatccctggtttagcatatgattaagaaataaccataaaaatagccaactagcagcccttggggctgctctgcccatggagcagccattcttttattccttttctttttaaataaacttgcttttactttactctgtggactcgccctgaattctttcttgcatgagatccaagaatgctctcttggggtctagattgggacccctttccggtaacaagaacactccctcaataaagcagggcataagtccctgtttcaggctttgctcctgcagaacctgcctaagacctgctgtgtgttgggcactgtgtctatgccttggagatagagtgttaaacccttcgagcaaagtctctgccccaaggcagctcagtgccttctagggggtctgattttccatatcctagtcttgtaatttgttttttcttttttctttttctgagacggagtcttgctctgccacccaggctggagtgcagtggcgtgatctcaactcactgcaacctctgcctcccgggttcaagcgattctcctgtctcagcctcccgagtagctgggactacagctgcatgccaccatgcccggctaattttttgtattttttttagcagagacggggtttcactgtgttagccaggatggtcttgatctcctgaccttgtgatccacctgccttggcctcctaaagtgctgggattacaagcatgagccaccacacccggcccctagtcttgtaattttgagaagtcgctggagctatgcgagcctcaaatttcttatcaatcgaatggtggtaacagtgcttgtctttacttttttccttctattttttagtcttgcactgtcacccaggctggagtgcactggcatgattccaccatactgcagccttgaactcctaggctcaagtgatcctctgacctcagcctctggagtagctgggactataggtacattctaccatacctggctaatttaagaaaaaaaaaatttttttttagacccaaggttttactattttgctcaggctgatctcgaactctggcctcagtggatcctcctgcctcggcctcttgaagtgttgggattacaaatgtaagccagggcacccaaccaatgctttccttttctgaaaagaccaagcaacagcagcagcaggatggtttaagccttcttaagcatctgtcagctgcccttccccatcaccacttccagatgacagccttgtcttctatttctagctaggttgctgctgctatacatggaaattctggatcctccattttaggaccatgaattgatagaaaactggctctcatgctgctacctaggtgtttgttgaatgaatgaatgttgaatatgattaacaacagtgctatcattcaagcagcccaggtactggaataagcactttattgcttcttttttaaaatttttttatagagaaggaaatggaggcattgaaataccaagacatactgaatatgagagcaattcaacaactatgtaaagcacatatacagatgtaaaatgttagaagacaggactttggatggaaggattaatttgcagcactgatgtttcctaagaaaatggtcagaagaaatttcttttggaatgttctttgttttttcttttttgttgtttgtttttgtttttttctgagacagagtttccctcttgtcacccaggccggagggcaatggtgcgatctcagctcactgcaacctccgcctcccgggttcaagtgattcccctgtctcagccctcctagtagctaggattacaggcacccaccaccatgtccagctaattttttgtatttttagtagaggcgggggtttcaccacgttggccaggctggtctcgaactcctgacctcgggtgatccacccgcctcagcctcccaaagtgctgggattacaggcgtgagccaccatgcccggcctggaatgtttttctataacttgttcctttttcagttcacatgtggacaacccttttaacccattgttcaaggtcatggagattgtttttgaaacttgaaaccaaacacttacagatggctcccccaaaggatagagaaaaggaaacgagaaacaagaaaatcacaaccacctgctattataaaaggagcccgcatgatgaagtttttagaattgtggatctgtacttctgctactgcttaggttttagtggaggcaaaataatgccaatagctaatttgtttggtcattaagctttgatagaacttcagtctaagggacatacaattatattaatgtacatgctccagagtccctggttttatgatctgtggattatttatcattgtttcaggatagcagtagtttactttggtttcatgatttttttaacattggttctggaatccaagagacttggtaggattctttgtttttgtctttccttaatattattatcatcatttttttctttttttttcttcatttgagacagtgtcccgctctgttgcccaggctggagtgcaagtggcataatcatagctcattgcaaccttgacctcccaggctcaagcgatcctcccacttcagcctcccaagtagccgggactacaggtgcatgccaccatgccttgctaatttttaaaattttttgtagacatggagatctccctatgttgcccaggttggtctcgaacttttgggcacaagagatcctccttccttggcctcccgaagtactggagctacaggcgagagccaacatgcctgacctgttatcatttttttattttatttttcttggctctgccatttactgtgtgaatttgggcgaattactcactttttaaaattttttctccccttcccttcccttcccttcccttcccttccctcccctcccctcccctccctttgtgcctccctgcctacctttcctctctctttcttttcaatagagatggggtctcactttgctgtccaggcttaccctgaactcctggactcaagtgattctccttcctcagcttcccaaatagctgggactacaggtgcatgccaccatgtctagctaatgtatttgtttttgattatggcataacaaagcacccaaaaacttagtagcttaaaacaacacgcagtttctaggggtcaggcatccaggtacagcttaactgggacctctactcagaggctctcacaggctgcaatcacggtgcccacaaggctgcagttatctcaagattcaacttggagaggctctgcttccaggctcatgtggtcattggcagaattcagttccttgagagttgttgggctgagggcctcctttcattgctggctgctggccagaagctgccctgtttcctgctagatggttctccctgacaacagggaagcttgttccatcaaagcaagcttgtgagaaaatatctctatctctgcctttatctatctatatgtctatatctacatagagaaagaagacagaactcacaggttttttttttttttttttttaacggttatggacagaattgcagccatctcccaatctcccaaatccacatgttgaagttctcactcccaatgtgcctgtatttggagacagggccctttcagagatacttaaaataagccaggttataagggtggggccctaatctgataggacctgtgtccttacaagaagaggaagaaacatgataggaaagaccatgtgagaacacagtgagaaggtggccgtctgcaaggcaggaagagagccctcaccagaaaccaaccctgctgtcctaccttgatcttggacttctaccctccagaactgtgagaaaataagtgcctgttgtttaatctcccagtctgtgatattttgttttggcagcctgagctgcctaatatgataacctgatcttggaagtgacatctcaccacttttgccagttctattccttagaagcaagtcatcaggttcagcccacactctagggaggaggttccacaagggcataaatacgagaatgagagggttggaagccacttagaggctgcctatcacgggcactgctgtctcttcctaagatggctaaaatataataatatttaacatttatctagcatttgcagttagtatatactaaacacggatgattcattaattctctcaacaaatgtgtgtgtgaggtattataattattccaattttacagacggggagaccgagtctcagaaaggtcaagtaatgtgcccagggtcacataacaagtaaaggacaggactgctatctgaacataagtaactcgctcagaggtctcaccctcccactcttgttttcctccaatctgctaccaacacaatagccagagcatttgctctgtcacccaggctggagtgcagtggtgtgatctcagcccactgcaacctccgcctcccaggttcaaactattctcatgccccagcctccttagtagctgggattacaggtgtgtgccaccacacccagctaatttttgtatatttagtggagacagggtttcaccatgttggttaggctggtctcgaactcctggcctcaagtgatccacccaccttggcctcccaaagtgctggggttacaggcatgagccactgcacctggcccagagcattcatttaaatcagacatgccatctcatttaaaaccctccaatcctattccactttaaataagttccaaatccccctactatgatgctgtgggctgaattatgtatccctcaccctaaccccctccaaattctaagtcctaaccctcattgtttccttccaaatcctaccttctttagagttagggcctctgtggaggtacttatgttaaaatgatttcatttgactgggccttaatccgatatgactggcatccttataagaaaggcatacaccgacacaagcagaaggcagaccacgtgaagacatagggaaaagtcagcattctacaaaccaaagagagcagcccagaacagatccttgtctcacagccctcagaaggaaccaaccctgctgacaccttgatcttcaacttctagcctttgaactgcaagaaaatacatttcagtcactttaagccaccctgccagcggcactttgtgtggcagctcgaggaagcagatgcctgccacttgctcctggctcacctaagccatggcagcctcctttcacttctttgcaaatactcttccatcttagggcctttgcatgtgtgttttttttctgcctagaacatttttttcttcttgttttgagacagagtcttactctgtcactcacgctggagtgcagtgacgtgatcatagctcactgcagcctcaacctccctgggctcaagtgattctcctacctcagcctcctgacgagctaggactacaggcatgtgccaccactcccagctaatttttttttttttttttttgagacggagtcttgctttgttgcccaggctggagtgcagtggcgtgatctctgctcactgtaacctctgcctcctgggttcaagctattctcctgcgtcagcctcctgagtagctgggactacaggcatgtgccactacgcctggctaattttttgtatttttagtagagatgggtttcaccatattagccaggatggtatccatctcctgacctcgtgatccacctgcctcggcctcccagctaactttttttgtagagacagggtcttgctatgttgctcgggctggtctcaaattcctgggctcaggagatcctcctaccttggcttcccaaagtgctgggattacaggcatgagccaccacaaccagcctctagaacagtcttacttcccttcctcaatgctcattccctcttattcctccactctcagcctcatttcacccctttagtgaagcttttaattcctttcttacctaaagagttctgcctgttgttctctaccctaacacactgtaaattttctttattgcacttaccacaatgtataattagacgtttctttgtttatttgttgcttttctctccccctagagtgtagagtctcaaggacaggaattgcatctgtgttatttgccagagcgtctccagcatacaacacagttcatggaacccagtgcgtgcccagcaacgatcagttgaatgactagagtagtgattctcaaccctggctgcacaggagagtcactcgggggtgctttaagaaacaatgatccttgattttcacccccgtgagatgctgagtcagtcccatgcaactagattgaggacaagaggataagggaaaccatttccttttcaatctgtgaaggtttgttacatttatggaaaacttgaacttcaccacagtcttacaggaagcatgaaattgagccttgagtttttttctcagctgtccaactgttatgggcctacaattgtatagctcagagtgacagagaagaactttggggttgggaaagaattggagcaacttcaagcaggaacgcggtgtggcaccttgggtgcatctcactgggttccatccattctatggtgttggggtcactctgctgtagagcaagatgcagaaatggccctctctactttccttatgtgtgtatgtgtggaggggaggtttagtggatgtctctggttactggaattctgtttgcattgcgctgccttctaggaccaaggactggttttcaagctctttggtcaagggagagagagcagtcttgagtctgtcagaacaggcccctgacaagtgaacagtattgatgccctccagccaaagacctccaggaacacacccatattgaacaagttgtgtttcatgttcattgcagcaagagaggacacacacatggggaaccatggaaggtgttggaaaggactcattatggaattggactttggttgtgtgattttggggagagtccaagcaagctgggatgtgcactggcatgggtgcagcctgaaagaggcaatgttaccattgactctctcaataaattttatctataaggaagggagggaaagcagactagagcgaggctaaaactatgattggtgaagaacactagttactcgcattcaccaggagaaggtcatgtttggcattttgtggcttgaacaatgttcctgttttgtctgtgttcacgtgtgattacggagtcttctttctgtcctgattcatcatgactacagagtggctttgtctaacattgatgctctgtgaaattgtttatgtttaggaaaacaccgagattgacctgtcagtaccaggccagttccctgctgtcaggggctgctttcctctttatcactagctttggatttgctccttccagtacttttctcatgtaaagtaaggtagtccagtgtgttcacacaattgagagcatttattacattagcctcctatcttttgcggggataatcacagcaccatggtgtggtaagtggcagtagagtatggtggttaagaacaaatgatcttgaggtcaggcgtggtggctcacgccagtaaacccagcactttgggaagccgaggcaggagtattgcttgagtccgagagttcgagaccagcctgggcaacatagcgagaccctgtctcttaaaaaaaagaacaagtgctctttattcagaaaatcattttagttgtgtgaccttgagcaagttcacttgaccaccctagcctcgactccctcatctgtaaaatgggggtaataatagtgcctaacttatagggcaattatgatgcaccaatgaaataatgcatgaggccgggtgcggtggctcacacctgtaatcccagcactttgggaggccgaggtgggtggattatctgaggtcaggagtttgagaccagcctgaccaacatggttaaaccccatctctactaaaaataaaaaaattagccaggtgtggtggtgcatgcctgtaatcccagctactcaggaggctgaggcaggagaatcgcttgaacctgggaggcggagattgcagtgagccgagatcgcgccactgcactctagcctgagcgacagagcaagactctgtctcaaaaaaaaaaaaaaaaaaaaaaaagcatgaaaaaacttttagcctggtatctggccagcagttggtatgctattgactaccaatgattcaatagaactatatgtttctctgcttagtttatcagagtttgcctttgtacctgtgatgaaaaaaacggtggaccgtaagaccttgggaccttggttccctgaaccaagccaggacaattgtattatttctcctggaattttgaaattggacaccaatatttgtcattcagggttggatatgtagactgggaagtgatgtcaagcgtccttgagtgaccactttctgctctgttgacttagaaccttgaggttaaaaaaatgttataggaaaccatatttgtttgaatgtttgttggaaagaaaagcagaaaagtagagaaaggtgatcttttttaattcttaattttttattattaaattttttttttattttaggtttgaggatacatgtgaaagtttgttacataaagatttgtcacagaggtttgttgtacatatcattacatcacccaggtattaagctcagtccccaatagttatcttttctgctcctcttcctcctcccaccctccccactcaagtagactccagtgtctgttatttccttctttctgttcgtaagctcttatcatttagctcccacttatatgtaagaacatgtggtgtttggttttctgttcctgcgttagtttgctgaggatgataggctccagctccatccatgttcccacaaaagccatgatcttgttcttttttatggctgcataatattccatggtgtatatgtaccacattttctttatccagtctgtcattgacaggcatttaggttgattccatgtctttgctatcgtgaacagtgctgcagtgaccattcacgtgtatgtgtctttatggtaaaatgctttatattcgtctgggtatacacccagtaatgggattgctgggttgatggtagttcttcttttagctcagaaaggcaatattcaaagacaggagaataaactggggtgagagagagaaggagtgaagaaaggagaaaagaagagagaagagagaggaagagaaggttctatggagctctaagtgttctatctggtctgcccgagttagtagagggataagaataaagaaaaaaaatgttactattcctctacggcccatcacacacatgggtgaatcaaatgggcaaagcaagagtagaattttacaccaccatgccgtaaacctggattgttttgactgttgagcatctcctctctcttttctattctttttctttctctttctttctttctttccttctttctttctttctttctttctttctttctttctttctttctctctctctctctctctttctttctcgctttctctttctttctctctttctttctctctctctctctctctccctctctctcttcttttcttttcttttgagacggagtttcactcttgttgcccaggctggagtgcagtggcgcaatctcggcttactgaaacctccacctcccgggttcaagcgattatcctgccttagcctcccaagtagctgggactacaggtgtgtgctaccacacccagctaattttgtatttttagcagagatggggtttcaccatgttggtcaggctggtctcgaacccctgacctcagataatccacccacctcagccttccaaaatgctgggattacagacgtaagccactgcacccggcctcactttcttttacccacatcagtcctgataatttccagtcccagcatcctgccttctccctcactcccgtagaaggactgggcaagtgaccaggccaatcagagttccccaatatcctggccatgtggattggtccagctatgggcacgtgaccttagctaagccaatcacctattcagaatgttttttgttctttaatacagagctgtgagagacagggtcttggcttttgaataatggggctgaaagaagtgagtcagggactgccaggggctgtctcctataccatgaggagaaatctcgtctatagggagaacgagccaaaagatggaaagtcattgagagggagagggagagggacattgaagtgggggagagaaagagagagacataatataatgttgagctttaaatcagctctatctagacttagaaaagccaataacttcccacttttcttggactgatttgagttggttttttgctactttagccaagtggtccccgtgatggctccccatttctttagatgaaaatcccaagccctcacgttggcatgccaggacacacctgccctagcctcaatggcctcatctcccgtccctctcgccattgcttactccgctgcagccattcctgcctccttgcttgttcgtcaaacgtgccaggccctacttcatacggattaaatcagactttttgagtgggatcaggacattagtattttatttgtttttaatttaattttatgttttgagacagggtcactctgttgcccaggctggagtgcagtggcacgaacacggctcgctgcagcctcgacctcccaggctcatgcgatccttctaatactcaccgttagctgggacctcagccagccagttaaccaaaatgtatgcgtgtggcctccccaggtgttctcttcacatgggctagttggacttcctcactacatggtggctggtgtgcaagagtgagtggctccagaaagcaaggaggacatgcctatgattttttatgctctagccctggaagtcaaatagcatcttttctgctgtaatcttaatcttaatgattgaggcagttgctaaggttcaagtggaagggatcatagacttcatcactcaacatgagaaatagaagcttacaaccacctgtcctcagcctcccaagtagctgggactacaagcatgtgccaccatgcctggctaattttttgaattttttggagagacagagtctcactatgttgcccaggttggtcttgaattcctgggctcaagtgatccacccgccttggcctcccaaagtgctgggattgcagatgtgagccactgggcccggccggtgacattggtatttttaaaaaggtactcagtgatttcaatgtgtagctagagctgagaatcactccttcagactaataaagaaggtcaatggctattaaggcaactaccctaaagaattaacttaaagtctatgtgtaagtttgtctcttgtcaacatagagtctagtttccttctaattttgattataaaataggaaagcattttcctatactataaaaaagtttgctttaagagtcccaggactgatttattatgaccttgagatttaaaaacatttattattggaaaccatgtttgtttgaaccatgtttgtttgaatgtttattgtagaaaagtccatttttccttttaaagtcataaactaaatttgttacaggaggttgattttgtgttccaagcctgtgatcattaactgttttccagctctaccaggtagggtattgaaccttttcttatttgagattcaaataaattctcctttaccaaaatgttattttgcaaataactaagtgactctaatggattaactttaaaatgcaatgccaaatcttgattttccacgaatgaataatttgaaagaaatttctctgttcactacatatacgccagaaagaatatcaaccttggcttttgatatattttaaattcctggttcaagtttcttatgtggccaaattgttcttagtgacctgggcttctgtaaaatgtccctgattcctttcataaaatgcttattttggcttatgctgctcgagtgagtttctgttaccatctttgataaagacaatcattaatcctgacagcagccttgcaaagtgagtcttactattcccatttcacagatggataatctgagcccttgggtactgagaaacttgctcaagtccatacaattaggcactggtagtccctggacaacaacccagatctacttgaccccaaagctgatgagtttccaccctcacagaaggtcctaatatggcacattgcttttttttacattgggatataattcatgtcttataaaactcaccatttaaaagtgtataatttagtggtcttagtgtattctcaagatttttcaactatcaccactgtctaattctaggatgttttcatcaccctccaaccccagacctctaccattaagcagccactctttcactcctgtcccccagcctctggcaaccactaatttactttctgtctctatggatttgcccattctgggtatttgatacacatggagtcatacaatatgtggccttttgtgtcttggttctttcacgaaacacagtgttttctaatttctaatttctacatttctgtcgtagaatatatcagtacttcatttctttttatggctaaataacattccattgtatggatagaccccattttgtttatttatctgtttacagacatttggattatttccaccttttggctattataagatacattttgtaaataacattgttatagaagtcttgttttccaaattaaacagaagggcaggtcctgtttcacacactttttttttgtattaaaaatatatgagggctcttccagttgctattactgggtaacaaatcacaccaatttttagtgctataagccacaattttattacactcacagatcctgtaggtcaagaatcagaccagagagggtggcttgctctgcctcatgatgtctggggactcagctgggaaaactcaaaagttgagggtgacttgatggctggggactaaaggcatctagaggaatcttctgtcacatgcctgtatttcatactcactgttagctgagacctcagctagccagttagccaaaacgtctgcatgtggcctccctaggtggtctcttcaggtgggctaattggacttcctcacaacatagtagctggggtccaacagtgagtagctcaagaaaaaaaggaggaagtgcatatgctttttatgttctagccctggaaatcaaatagcatattttctgctgtaatcttaatgattgaggcagtttctaaggttaaaaggggagggatcatggacttcatcactcaacacgagaaataaaaggtcacattatgacagcatgtggtatgggagatatcactatggccacctttggaaaaaaaccatctgccacaaggaccttgcactgggcttgtgacaggtatccagtagatccttatttaattaaatatattcatgcttatcaacaaattacatattggcctgcctgcttgtttgttcatgaatccatctcctccttcagaaatgaccccttcttgggtattattctaatgctttcatttcttaacttctgcattttcctagcttaggcaaatcactttacttctcagagcctcagttgtcttacccataaaatgggcaaacacatttgttcccactctacaaaattagtttgggaattcagtgggctaaggtataaatagtgcttactttagatgctgtttggaggtaaaggttcaataaatgataactattattattgctgttgtgattacctgaatgtaatccccattctcttatacttttcagcatcctgtccaagcctttaagatgaggaacaaattctatgtgaggagaaatggcaaaaattggtatgcctctgcttttctgatttcccattcccttccatttctcttattaacaagtaaaagtaaggaaatcctgtcctgtggataacttcccattgacttgcagagagctcagacatgctatggtagatatggatactattttgtttttgttttttgagatggagtcttgctcagtcacccaggctggagtgcagtggcatgatctcagcccactgcaaactccgcctcccaggttcaagtgattctcctgactcagcctcccgagtagctgggattacaagcagatgccaccacacccagctaatttttgtatttttagtagagacaaggtttaaccatctttactaaacagactaggcccgtcttgaactcctgacttcaagtgatctgcccgcctcagcctcccaacgtgctgggattataggtgtgagacactgcaccttgccaatggtgaatattgttgatttaaaataatagatataataaatctccaatctcagggaagtttccaagtcctaaagtcaaaacttccgatcttgccgtgtgcttgaattatcctcaattagagtccctgctgctgttgcatgtcgctgtaattattctgtcatcgttaattcaatgaagcctattaacccacatcagatagtgtatttatctacaatgcatgttacctgctcctctagataagacagctgtcatacttcaagtctgctgtctctttgttgaggtccagtagtgtcagtctgcaagtgtttcatgtttcatatacattacagaatccccattaatggttgatatgattaggctttgtgtccccacccaaatctcatcttgaattacattccctataatccccacatgtcaagggagagaccaggtggagataattaaataatgggggcagtttcccccacgctgttttcatgacagtgagttctcacgagatctgatggttttataaggaacgcttccctctttgctcggcatttctccttcctgctgccttgtgaagaagatgcattgttttcctcttcactttctgccacaattgtaagtttcctgaggcctccccagccatgctgaactgtaagtcaattaaacctctttcctttataaattacacagtctcaggcagttctttacagcagtatgaaaatggagtaatacaatgatgttcttataacttcccagactggaaggcttgctggtcttgtgagatactgaactggagacagcagaaaaatgcatcctcctgatattgtgagcaacctcctctcttcttccctctctcctcttcttccctttcttctgttttcccttctaggagccaagagcataggctctggaaccagcctgcctggtttgaatcatgcctctgcctggggatcttgggcaggttgcttggtctctctgagcctgtttttttcatctgtgcaagaatcacaactctcttgtgagaatttaatgtgctaatctgcataaagcacatagacaactgtctggctcatgatgggagtgtaactgtggttatttcttcctattttcttccctcccttccaacagaagaaagtctctgagatgcgtgtcttatgtggcatatgctggacttggtgcctggggttcattggcagactagtccctctggtacctccagcaaggaagatagatgttaattattaattgatacccattgtgataaatctcacaaggtaccatgaatgggtataacagctccctttctgtggaggaggtggaggtgataggtaagacttcctggaggaagtaacatttgaacagagatctgaaagataaaatacttccaggaggagtgtgtgtgtgtgtaagtcagtcaacatcagaacacctccagcagtggaaacagtgtataggaagctctgaagtaggaaggatcctctgttaatggtttttttgttgttgttttccctcttcgagacagagtctcagtctgttgcccaggctggaatgcagtggcacagtctcagctcactgcaacctctgcctcccaggttcaagcgattctcgtacttcagcctcctgagtagctgggattacaggtatgcaccaccatgccccaatcattttgtattcttaatagagatagggtttctcaaactcctggcctcaagtgatccgcctgcctcagcctcccaaagtgctgggattacaagtgtgagccaccatgcctgacccattaatgttttgaataggtaatactttcgcatggtccaaattccaaaaaatacaaaaggataaacagtgaaatgtctccctttttccatttaccaccttccccctacctctatccctgaagcaacaaatgaaccaatttctttggtattcttctagaaatatcctgtgcatacataagcaaaatgtatgtgtgtatggtgtatatacatatatacacacactatatatagtgtgtatatgtgtatatatatactatatatagtgtgtatatatatacactatagtgtgtatatgtatatatactatatatagtgtgtatatgtgtatatatatactacatatagtgtgtatatgtatatgtgtatatatacacatatatatactatatatagtgtgtatatgtatatgtgtatatatagtgtgtatagtttatgtatatacatatccacactatatatagtatatatatgatattcacatatcatcttttattttttaatatgaaaaatgcttctccgttatttgcttttttcacctttctcttaaatacgtatcttggagatccttccttatgagtacacagttaactttcttattttcttttctgagtggcagagtacaccatgtagtaccctataatttgtttaagcaacctcctactgatggatgtttgggttatttctactcttctgctattatttaaaaaaactataatcgataatctgataccggtgcaatttgctcctgtgcaactgtctgtgggataaatttctaaaagtgtaatagttgggtcaaatgacacacttttctccacagaggttgtaaaaaatttacacccacccctcaaggaatgtttgagttcccatagtggcatcaagcaccatgtattattgagttctttttaattttgccaatctgataggtgaaaattcatatctcagcatagttttaatttgcatttatcttactctgaataacacagagcgtgttttcatttgcccaagaatcacttgtgtttcttttcttacgaactgttcttatcttttgtccatttttctgtgatgaatctgctcttttgcttattgattttatacattaggggaattagccattttccacgccatgcttcacaaacattatttcctgggttttcttttgtatttagactttgcttagggtggttttggttctgcagctctgttttttaaaaaacttttatgtagtcaaatttttttttttggggggggggtctcctggatttgtgacatacttggtctcctgcatttgtgacatgctaagaaaaacctttgtcatttcaagatcataagataattctattctttaaaaaaacaccttcagaaaaggggattccagatgcgactttaatgatcctttcctgtgtttgccaagcatcatggtagaaataccttccttatagccacatgaaacccctgatgctggagtgttgtgttcaccttatcggcaaatatttccccagcacctcctatgtgtcagtgtagaactgaacagcacagaagctacaaagactaagaagccagcaaaagttcaaattccaccacccagaagtaaccaccataaacacttggtattatcatgaattttttttataaaaaactccataagcacatatttttaagataaaaataagattattgtacacataatttttctgacctgatttcaaaatatatccaagacttctttctctgttactaactgtaaatgtagatttaacatttaacatttaactacggcaatgatttacatgtagcagggtttgtgaaatgactccttgtggatggacagtgagactatcctccctcttccaccattctaagcaatgctaccaagaacatctttacatgtctatctttgccctcttgtcttagacctagaatttctgggtcacattgttaaactgtttttaggaagattgtgctgacttatattcccacgagcaatgtaaggtatgccagaaagagggcaggaggttgggagtgggaggagaagggggcggaggaggaaactgggtaaatgctattggtgataaaaaggagacagtctcactgtctatcaatagggaggtcattcagcaaatcctgctacatgcaaatcgttgcctagtcatgaaatattaaatgttaaatctacatttacagttggtgacagagaaagcagtcttggatttattttgaaattaggtcataaaaattatgtatgcaatcatcttatttttgtcttgaaaatatatgttcatagagtttaaaaaaatcattcatgataaataccaaatgtttatagtggttatttctgggtggtggcatttgaactgttttatttttattggcttttttttttttttaattgagatggagtcttgctctgtcaccccggctggagtgcagtggtgtgatctaggctcactgcaacttctgtctcctgggttcaagcgattctcctgcctcagcctcctgagtagctgggattacaggcacccgccaccatgcctggctgatttttgtaattttagtagagatggggtttcactgcattggacaggctggtctcgaactcctgacctcaggtgatccactgccttggtctcccaaagtgctgggattacaggagtgagccactgcacctggaattttattggcttctttattcatctttgtagtttctgggctgttcagttgtatattgacatatagtaggtgcttgggaaatatttgctgatgaaggctattttgggaattaaaaaaatgtatttcagggggcagcaaactatagctctagggccaaatctggtctctgcctatttttgtaaataaagttttattggaacagcctcatacacctgttcatttacatagcatcagtgattgctttggccctacaagggcagagttaagtgattgcaacagagcccacatggtcaaaagagcctcaaatatttactaactgatggtttacagaaaacgtttgctgcctcctggtttatttcattaaagaagttatattacacctctttggtgtctccattccctttaccacttatgttaacgtgggaatgatgacaccaacctggaagagtcacatacgtaaggcatacagcccagtgtttgtcttttggtgcatgtataatcaatactaattcaccttcccttcctaaagacttttactcccaggaagtggaagcagaaaatgggcaggtatgaggcaccgggttggtgatagttcttctctgcttttacttcccattttctgtcccaaagtttgaggagttcattttttcccttctgagtaaaaaaaattttttttttttttgagacagagtcttgctctgttgcccaggctggagtgcagtggcatggtctaggctcactgcaagctccgcctcccaggttcaagctagtctcctgcctcagcctccctagcagctgggactacaggcgtgcaccaccactcccagctgatttttgtattttttgagtagagacagggtttcaacatgttggtcaggctggtatcgaactcctgacctcaagtgatccgcccaccttggcctcccaaagtgctgggattacaggtgtgagccaccgtgcctggcttctgagtaactttcaaacacctgaagccccaaacttagaagtcacaagaatcatgtcaagcctaataaatgactgttttttcctgttatcaaactttttagggaaacaggatttctgtcacttacttggactgaataacactcacacatatttaaaaaacattgtagggagtgttttggatggatggtatcaaggaatagggggtctgcagttgtcatgcacattaagcagtggcattgaattagggtctgtgggaaatctggtagtatcagagcatgcaggcttctcaacctctgtactcctgacattttaagctggatgatcctttgttgtgcgggctgcaggatgtctacctggtgtggtagacagaacaatgccccctctcctcaaagatgttcatatctcaactcctagaatctgtgaatatattacattaagatggcaaaatccaaacgaaaacaaagcaagagaaaactctcgcagatgtgattggaatgaaagatcttgagatgaggagattattctgagttattcaggtgagactcaggtaattgcaagggtccttagaagatgatgtgacatgatgatagaataagagtgggaagagaagatgttaccctgttgctttgaagatggaggaaggagccatgagccaaggaatgcaggcaacctctagaagctgggaaaggtggggaatagattctcccctagagcctccagaagacatgcagccctgtggactcatttttgtcttctgacctctagaattataagaataaatttgagttgtttaaaaccacttaattggctgggtgtggtggctcatgcctgtgatcccagtgctttgggaggctgaggcaggagtattgcatgagcctaggagttagagactagcctgggccccatctctccaaaaaataacaattagctgggtatggtggcatgccctgtagttgtagcaactcaggaggctaagatgggaggatggcttgagcctaggaggtcatggctacagtgagctatgatggtgccactgcactacagcctgggtgacagggcaagaccctgtctcaaaataaaaaaataaaaatgaaaccactaaattcatggcaagtttttacagttacaataagaaatggttacacctggtctctacctactggatgccagtaacaccgcattcccctcaccccactctttttttcttttcttttctttttttttttttgagatggagtctccctctgtcacccaggctggagtgcagtggcgtggtctcggcccattgcaacttctgcttcccgagttcaagcaattctcctgcctcaatctcccaagtagctgggattacaggtgcccgccaccacgcctggctaatttttgtatttttttaatttttattttttattttattattattatactttaagttttagggtacatgtgcacaatgtgcaggttagttacatatgtatacatgtgccatgctggtatgctgcacccattaactcgtcatttagcattaggtatatctcctaatgctatccctcccccctccccccaccccacaacagtccccagagtgtgatgttccctttcctgtgtccatgtgttcttattgttcaattcccacctataagtgagaatatgtggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattattggacatttgggttggttccaagtctttgctattgtgaatagtgccgcaataaacatacgtgtgcatgtgtctttataacagcatgatttatagtcccttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttcaatgatggccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctagatattagccctttgtcagatgagtaggttgcaaaaattttctcccatgttgtaggttgcctgttcattctgatggtagtttcttttgctgtgcagaagctctttagtttaattagatcccatttgtcaattttggcttttgttgccattgcttttggtgttttagacatgaagtcctttcccatgcctatgtcctgaatggtaatgcctaggtttccttctagggtttttatggttttaggtctaacgttgaagtctttaatccatcttgaattaatttttgtagaaggtgtaaggaagggatccagtttcagctttctacatatggctagccagttttcccagcaccatgtattaaatagggaatcctttccccattgcttgtttttctcaggtttgtcaaagatcagatggttgtagatatgcggcattatttctgagggctctgttctgttccattgatctatatctctgttttggtaccagtaccatgctgttttggttactgtagccttgtagtatagtttgaagtcaggtagcatgatgcctccagctttgttttggcttaggattgacttggtaatgcaggctcttttttggttccatatgaactttaaagtagttttttccaattctttgaagaaagtcatttgtagcttgatgggtatggcattgaatctacaaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcccgagactttgctgaagttgcttatcagcttaaggagattttgggctgagacaatggggttttctagatacacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgcccgttttcaaagggaatgcttccagtttttgaccattcagtatgatactggctgtgggtttgtcatagatagctcttattattttgagatacgtcccatcaatacctaatttattgagagtttttagcatgaagggttgttgaattttgtcaaaggctttttctgcatctgttgagataatcatgtggtttttgtctttggttctgtttatatgctggattccatttattgatttgcgtatattgaaccagccttgcatcccagggatgaagcccacttgatcatggtggataagctttttgatgtgctgctggattctgtttgccagtattttattgagaatttttgcatcaatgttcatcaaggatattggtctaaaattctcttttttggttgtgtctctgccaggttttggtatcaggatgatgctggcctcataaaatgagttagggaggattccttctttttctattgattggaatagtttcagaaggaatggtaccagttcctccttgtacctctggtagaatttggctgtgaatccatctggtcctggactctttttggttggtaaggtattgattattgccacaatttcagagcctgttattggtctattcagatattcaacttcttcctggtttagtctttggagggtgtatgtgtcgaggaatttatccatttcttctagattttctagtttatttgtgtagaggtgtttgtagtgttctctgatggtagtttgtatttctgtgggatcggtggtgatattccctttatcattttttattgcatctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttaggatgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgagtttcttaatcttcagttctagtttgatcgcactgtggtctgagagacagtttgttataatttctgttcttttacatttgctgaggagagctttacttccaactatgtggtcaattttggactaggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtagatcactcaggacttgctttatgaatctgggtgctcctgtattgggtgcatatatatttaggatagttagctgttcttgttgaattgatcccttgaccattatgtaatggccttctttgtctcttttgatctttgttggtttaaagtctgttttatcagagactaggattgcaacccctgcctttttttgttttccatttgcttgttagatcttcctccatccttttattttgagcctatgtgtgtctctgcatgtgagatggtttcctgaatacagcacactgatgggtcttgactctttatccaatttgccagtctgtgtcttttacttggagcatttagtccatttacatttaaagttaatattgttatgtgtgaatttaatcctatcattatgatgttagctggttattttgctcattagttgatgcagtttcttcctagcctcgatggtctttacagtttggcatgattttgcagtggctggtaccggttattcctttccatgtttagtgcttcaggagctcttttagggcaggcctggtggtgacaaaatctctcagcatttgcttgtctgtaaagtattttatttctccttcacttatgaagcgtagtttggctggatatgaaattctgggttgaaagttcttttctttaagaatgttgaatattggcccccactctcttctggcttgtagagtttctgccaagagatcggctgttagtctgatgggcttccctttgtgggtaactcgacctttctctctggctgcccttaacattttttccttcatttcaactttggtgtatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctatcactttcaggtacaccaatcagatgtagatttggtcttttcacatagtcccatatttcttggaggctttgttcgtttctttttattcctttttctctaaacttcccttcttgcttcatttcattcatttcatcttccatcactgataccctttcttccagtcgatcgcattggctcctgaggcttctgcattcttcacgtagttctcgagccttggctttcagctccgtcagctcctttaagcacttctctctattggtgattctagttatacatttgtctaaatttttttcaaagtttttaacttctttgcctttgctttgaatttcctcgtgtagctcggagtagtttgatcgtctgaagccttctctcaactcgtcaaagtcattctccgtcaagctttgttctgttgctggtgaggaactgcattcctttggaggaggagaggtgctctgtatttagagtttccagtttttctgctctgttttttccccatctttgtgattttatctacttttggtctttgatgatggtgatgtacagatgggtttttggtgtggatgtcctttctgtttgttagctttccttctaacagacaggaccctcagctgcaggtctgttggagtttgctagaggtccactccagaccctgtttgcctgggtatcagcagcggtggctgcagaacagcggattttcgtgaactgcgaatgctgctgtctgattgttcctctggaagttttgtctcagaggagtacctggctgtgtgaggtgtcagtctggccctattggggggtgcctcccagttagggtgctcgggggtcaggggtcagggacctacttgaggaggcagtctgcccattctcagatctccagctgcgtgctggaagaaccactgctctcttcaaagctgtcagacagggacatttaagtctgcagaggttactgctgtctttttgtttgtctgtgccctgcccccagaggtggagcctagagaggcaggcaggcctccttgagctgtggtgggctccacccagttggagcttcccagctgctttgtttacctaagcaagcctgggcaatggtgggtgcccctcccccagcctcactgccgccttgcagtttgatctcagactgctgtgctagcaatcagcaagagtccgtgggcgtaggaccctccgagccatgtgtgggatataatctcctggtgcgccgttttttaagcccgttggaaaagcgcagtattagggtgggagtgacccgattttccaggtgccgtgtgtcacccctttctttgactaggaaagggaactccatgatcccttgcacttcccgtgtgaggcaatgcctcaccccgctttgggtcacacacggtgtgctgcatccactgtcgtgcgtccactgtctggcactccctagtgagatgaacccagtacctcagatggaaatgcagaaatcacctatcttctgcatcactcatgctgggagctgtagaccagagctgttcctatttggccatcttggctgccaaactaatttttgtattttttgtagagatgcaatttcgccatgttggccaggctggtctcaaactcctgacctcaagtgatccacctgccttggcctcccaaagtgctgggattacaggcatgaaccaccctgtccagcccccattcccaatttgtgatcaccaaaaatgtccacagacattgtcagatgctccttggggagcaaaatggttcccagttgagaagctctgtgttagagagattccaacagcagctgcaaaaactcagatgcaagaagttggtgcctgcactcagctgagtgcagtcagtgggctgtggggagctgggagaataggtaacccatcatgctcactgttgctcctctctgctgccttgccctgtggggattcatgcctggatgcttggagagcatggttgggctgaccaagaatccttattgaatgtgacaagttgccccattgggcccctgcttcttagcccaaggatgaaagtcactctttgtggcagcttttccctttgggtcagactcctttgcctgactgaccaattcctttcatgctggcaggaaggacttccttctatctaagccacagtagctaagtgttgcctggttccatgcaatagaaactgactctgattaagtaaggaaaataaattcgtgattgttaggataacaggtgctctcactgaatgagagaggagtttgcataggaaggaaaatactaatagagttttggaagcttagcagcagatggaattcatgatctacctctcttaaaaaaattttttttagagacacggttttactccatcacccagaccagaatctagtggcaccatcatagctctctgtatccttgacctcctgggctcaagcaatcccgctgcctcagccttccaagtagctaatgccaccatgccaccatgcctggctaatttttaatttgctttttgtagagacagggtctcgctctgttgcccaagctggtcttgaactcttggcctcaagcaatcctcctacctcggcctcccgaagttctgggattagaggcgtgagccacggcccccagcccctacctttcttgagttctaccattaatgtgtctcactttccaatctcggattccaagtttcaaattcctgggggagagaatcctattgcttgggctccatagatcaacccactgagaccatggggagagacttgcccaaggtcacacagcctgaatagcagagctgggctgcctctctcgactttcaggactgttctttttccatgatagtttttggggagatggaattgtctagttagagagttacctgagagccaatatagtaagaaaagttcctcgccaggcaactgaaatgacacaggaactgaaaactgtggacaaactcgggctgttttttctagtaggtatcaggcatcaagatgtttttagataactagagatgacatttactttgacatattgaaaaatagttatgacagagttttgagaggcattattgtgaaccatagtagtgtgaggtcttaaaaagccccttcttcattttttagctgtttctaatttccacctaaattgtctcagatcctttgctaattgccaagcctgattgaatttccagttccttattcctttcctgggaccactttaggctctgactgacttctccttaggtctctgtttaaacaccaccattacaacaggttttatttagttttttttttttttctttttaagacggagtctcactctttcgccaggttggagtgcagtggtgcgatctccactcactgcaacctctgcctcctgggttccagcgattatcctgcctcagccttccaagaagctgggactacgtgtgcacgccaccacgcctggctaatttttgtatttttagtagagatgggttttcaccatgttggccaggatggtcttgatctcttgaccttgtagatccatccacctcggcctcccaaagtgctagaattacaggcatgagccactgtgcccggcccttatttagtttaaattcagcaatcaattcacatttactatataaaaattcaaaacacagatatgccaattaaaatttaaaaaatcacccataagctgaccatctagaaaaaactgtacatttctctattccgcatccttctagattatttttcttatcagtttatacttatgcaaagtggtattatacttcatcttctgttttgttactgactttattcatttagttattaaaactccttaaatatgtgttgattacattgtttacttaatttttttctttttattttttttagacaaggtcttgctctgttgcccaggctggagtgcggtggtgcaatctcgctgactgcaacctccgcctctcaggttcaagtgatcttcctgtttcagcctcctgagtagctgagaccataggcatgtaccaccatgcccgctaactttttgtatttttagtagagacagagttttgccatgttggccaggctggtctcgaactcctaggcacaagtgatccacgtgcctcagcctcccatgttgctgggattataggcgtgagccattgcgcctggccaattacactttttaatagcttcaaagcattccattccctggttatgccatgattgattgaacatatccattattcatttttgagagaacttttttgtttctgtgttgttgatggagtgatgttatatagctgcagaataaatcaaaccatgactaatatttcataatttcatgaatttatttcattttggatagttacccaattttttttggtcctttctgattttagaatattttgttatgacattcctttgtgacactggggagaaaatgtacttttttcccaggtcagaggtgtccagtcttttggctttcctgggccacattggaagaagaagaattgtcttgggccacacatagaatacgctaacaccgacgacagctgatgagctaagaaagttgatgaatttatgttgagccccattcaaagctgtcttgggccacaggttggataaccttgccctagtttctctctatgcctttgagctgccattcagactcctttgaaagatggattatcttatatatacctatgtattttctgatgcccactctccccatttgactacctgtggagttgaaaacaagtccgcctactctaatcaaatcatgatgctctgtccggggtcacattttgtaaccgacaaaacagtgcatgaggagttccggttttctcgtatcacaagattttattgagcagctactatgtgccaggcagtgtgctaggctttggagacttgtacaaattatcctggggtatctcagcagggaagtccttatttgtttattaatttttcctgacggtcaggtccagttagtctcactctaaacctggggcttggaatagagggacctgagacaccacattagctgcatgacattgggtgactagattacattctttgtatccattttcatattgataaagttaaatcggctcagagtgagggttataactctagcatatatagaggccacagcatatagtgttatatgctgtacaaaagacacaacacacagtaaatgattcaataagcaatggccatctttattatttacgttgttatcatattctgctgaaaggcttatgtatcaagtacaagaaaatgtataacccagtcatttgttttttatccaaggcagctgatgaagaagacacttattagcccaaagagtgaacagggtgagaggaggaggttattggctgcttctctgcggttaatttagccatcatttcagaatggagctggtatgctttgagtgtgaaagaaacctgctgcttgttgatgattagtctggttttaatgagttatcaggtgtcaataacagcagaagtgcactaacttttcacagccatcagaggatgttcaggatgttcactgggttctcacttttcagggttttctgtgggtgttagaggttgggctgaggagggcctgataggacatatctatctctgcaagtcttaggcaaagaagctttcgtgatgatgtattaggctgttcttgcattgctgtaatgaaatagctgagactgggtaatttataagagaagaggtttatttggcttacggttctgcaggctgtactggaagcatagctccagcatcagcttctagggaggcctcaagcttgtaatcatggtggaaggcaagggggaggaggcatatcagtaggtggggaggtgccacatacttgtaaatgatcatgtgtcgtgtaaactcactcactatcacaagaacagcaccaaagggatagtgctaaaccattcatgagagatccgcccccatgatcccaatacctcccaggaggccccacctccaacagtggggattaagtgagagttgggtggggctccttgctcctcttcccagttaatccttaatctccaccccaactccaggcaaccactgaacttaacctccccttccccttcctctccttcttccccttccccttcccctccctgaggtgtctgtcagttacccagactagagtgcagtggcatggtctttgctcactgcagcctctgcctcctgggctcgagcaattctcccacctcagcctcctgagcagctgggactacaggcacataccaccatgcctggctaatttgttgtatttttcaaagagatggggtttctccatgttgtccaggctggtctcgaactcctggggtcaagcaatccacccggctcaacctcccaaagttctgggattacaggcatgagtcaccaggcctggcccactgaactactttctatcccaatacattagatttttctttctaggagtttcatatgaatgaaatcatacagtatgtgctcctggcttcttttgcttagaataatgctttggttattcatctgtgctatttattgtgtgtatcagtcatgtttttctattttctcaccttgagaagtattctgttttatagtacaaaacaatgagtatgtccattcaccttgaggaagattttatttgaagaaatctttgtcatcaaaaagcttgaaaaccagggctctaccttgatttcatagtcttgagaatgatggagaactcaatttataccatgattttcattgagaaagcaggttgcatgttaagagattaggtgataggatgactgaaaggtatttgtgatcttatgaaaggtacaatgtggcaggcagcctctatgagggaccccagtgatccctgtctcctggtattcatgcctttgtgtaataccctccccttagcatgggctggacttactgactcacttgtagtgaatgcaatatggctgtcctgatgggctgtcacttctgaaattagcttatgaaaaaaccgattacaggtatatctcattttattgcacttagctttattgtgctttgcagttattacattttttacaaataaaaggtttgtgtccctcagtcaaacaaaaatgcaatgggtttctttctagtcccccacctcaattttagaaattaaaaaattttccaaacacagtgagtagtagtctatatctgaagggtgaatgaagcaatgagtgaccaagttgcccacttaaggaggcacttcacaacaataaacaaagagcctgctctttggtctcagacctgggtttgagttctaactctgctactccttgactgtgagatcctggccatgtgacttaccttctctgagcttctattttctcatctgtgaaatggggacaataattcttacatcagtgcattaagtgagagaatctagacagcacagtacctaacacaacacaatgactcaatttattattgttgttgttgcttcattcttatttgtaaacactcaactgtcttcacaaacttcaggagctcttcaatgagacactgtgtccattaacagtctcatccaatgggtaatcttgaagatagatgattctatggtaggttctgaaacatctcctcttttactctatcatggtgtcaaagaccaggatggtacagaggtccaggagtctggcctatgcagtcagagaaactgatttgaactctacctcttccacttattaaccaaggggctttgggaaaattgtgagcatcaccaggctcatggtgaagatggggttaataatagctccaaccttatggccttaattgagataattaatgcatataaaaatgaaaccatgtcttttgcagcaacatggatagaactgaaggccattatcctatgtgaaataactcagaaacaggaagtcaaatactgcatgtggtcatttataagtgggagctaaacaatgggtacacacagacatacagagtaaaataacagacactggagtctacaaaaggtgggaaggtaggaggggagtgagggttgaaaaattatctcttgggtacaatgttcgctgtttgggtgatggatacagtagaaacctagatctcatcataatgaaatgtatgcggttaagaaatctgcacctatatcccctaaatatatacaacttttaaaaaattaaaaaaatgattaatgtgggccagcacacagtgatcactcaacaaatgcaaactcttattcttgtaggagttgagggaagatgccaagaccaccccttctccaacttttaatgtcctggtattttgtcttaaacatttggaagcatctgcaggcagggattttgtcctcctgtctcccttccgatggcactggcctgtttggatcagtggaaggctctcctgcccctcctcctttcttcccagaggttttcttttgcactttggacttctattcatggatccttctgccagggacgtggaccaagaattcttcctcttttgcagatttcttcccctaattgtcctgttttgtgctgtcacccctgtgctctccctcctccccagttatcagcagctggcaggaaatgtttatagaagaagcctttctttctgtttttaatagcctcctaggctgcaacctcccaaatgagaaccttgttaaccagaaggactctaggctactgatttatatttcagtcataccgagaggaggaaaaattacaaagggagaaagaaaaatgccaatgtacacatggactagttccgacatcttctctgatgaagaatgtatatatctattcaggctctggatgctaagggattccttccagatctcagtatttgacctcttacttttgggtcacgtggattcttcgtgcctcttgtgggcttgctgaaagcaaaagtaacaatttcatactcttgccattgaaacaaggggtctattacttttaaatcataagggcacttgtttcaacagaaatgttagtatcttggtgaagatggggtctaagttcttggtggcttctgaggatggcgaagggctcaccttctgtcatcccgaaccatcactgatgggacagtgtctctccatgtgtagctatgcaaaggccacagaacaaatgggtaaaaatatttggtggtcagaattctagctcaatagtcaaggaaggcttcctggaggagaaagttcattttgaactgggctttaaaagttggtgtcacagaaaatgcaagctgtccctcagaattaagactagagttctgtgaaatagtgattgcaaaaatggccacaattattctcctctctataggcacacccctttgcaatgtgacattgtagcttctcctattagagtctatttccccacccttgaatccaggccagtcttgtgacttgctttggctaatacagtgtgatggaggtgacagtgtgccagttctgagcctaaatctcaagataacttgcacacttccactcaatctcttggaatcctgcccaaccaccatgtgaaccagccccagctagcctttgggaggatgggatgccacatggagaggagacagcccaggtaaggaccagtcagcacccgaccaaccaggcagctaactgctggtacctgagatgggcccaatcaagagcactacatttgcccagatagacccagcgcacattgccagcctgcagaatcatgtgctaaatgaatgcttattgtttaaagctgccgaatagtggtttgtgatttagcaaaactaactagtacagtttcctatgcagctgagtgtatccatgtgactaagtttctacatacaaaaacggtgtgtgtaatttctggggaatttccttccagggagaaggtatgctcttcttccactttttttcctttatattgcctggaatgggtatgtaatagctggagctccagcagccatcttggatcatgaagtaagtttaggaatggaagacactcctggcagagcaataagctgggagggtcttgttcctgtaaaaccactgattacctttccagttctattctggtacttctaaatttactaaacagaagttaataaacttttgtttaggtcattgttttgagttttgcagttactcatagctgaacctattgcaaaagaatacagatggtcaggatttaaacaagcagggatggcagagaagggcatccatgacatagggaatataacactaatgttgcagagaaagaaaaagtgtgggtaatgggtgggcaatggtgaataactacatatgcctaaggggagcagtgggtgatcaaattgggaaccatttgggaccagcttttgaaaggcagactgagaagtttggagagggtggtagacaaaaatgtgtgagtacttatgcaaatcagagtaagaaagtcatatattcatttttcccccactcattgattcatttcttctaggaagtttacactgtgtatgagggaaacatagcaaaatagaaagatgattattgattgttatgcatggtctgaactaaataaactctgtgatgtggcagagattaactgttgggcggagatggctactttaggcacagtagtcagaattttttgttttctagaaattctgttaggccctgtgcagaagtctaggaacacagggatgaataacacacacttcctgtcattgaagagatcacaatctggtgtggaatgaggttaatcaggaatattttcctagtggaggtagaatagagccaaaggaaataatgtagttttcccatatgtatctgtcagatattgctacaacaaggttgcataacaagcatccccccaaatcttgcttacaacaaaaaaatattttttccttcacaggtctgtgcataggctgtggttctgctgggctctgttggctcggcttgactccacgctgtgggttggtctgggtctgctctatatatctttttattctgggaccaatggatcccaaagatttgtacttctcagggtggatggcagaagtgcaaggggccaaaccagaccacagaggcacatataatgctttgacttgcatcacatgtactaacacaattggcattagcaagactgatatcagtgggtcaggatgtatgttccactcacagtgggaagattgcaaaggtgcaaagatgtataattctgttaagagagggaatgaagagtcgggaacaatatccagcttaccataccacccagcttacttaccattccttaccatacaaggaaataatgtatttctccatttttcaagaacactcatgtctgaatagttttattattttcttcaacaaatcttttatcttgttagatttattgcaacgagccatatttctcttttttacaaaatttatttagaaagttacatatgcacatatggtaaaaagttcaaaaagtggtaccaaaagatataacagtgaaaataaggctggttcttgtttttatccactgaggcaaatactgagtttattttcaaaggtattctgtgtgggcacaatcacgcttgcatatgttaaaaaatacaaaatggtatcatacttgttcctctgcactttcttttttttctatttaacaacatatcttagaggtagtcctatttcaatttagctagacccatttcattctgtttaatggctacatttgtttttcattgtgagactgtgccgtaatttatttaatcagtgccatattgaaagacatttggatcgtttcccagcatttgcaactataatcaaggttacattaaatatcctgttacatgcaggaagatactttattcacatgcatgggtatatcagtaggttaaaactcaaatacagaaactgccaggtcaagagatacacatcttaaagtttaatagatattgaccctgtttctaaaaagaaagattccttccagcgtgtctacacacatttgtctgctcctctgtcttctgattcttgtcccatggtgttattttaggctgaaataatggaatatggtggctcaaaaaacttattcccataggatctctgggaaagctttgggtcttgccacatggtccccagttgaacacaggaagtacttggcactgttgttgcaacccaaatcatcactttaatgagcgtgctggaggagcgtggaatgtttccacaagcatgtgtactgaagaattccatgctgcaggcgaaatgatttatatccctgggagttcccagtaaaaaaatgtgcacagtaccctttaatttgatctgctttccctgtagcacctaaatatttagggcaaatagaaaatagttctgatttacatctctataaaaattttaaacaacctaacaagacatttgatcatgaaattgcctgaaataatgttggcactagtcagccatatttcttcaaaatggcctgtaacttcagtgcaaactcccaaacatggatttttttttcctgctaataacagtcttattaataaaagaatgattttctttactgatcctcagcagctgtgttccgggtgtctttgttcaataaaggtagagataataactgtcagtggaaagaaaatgtgctgaggttcccaggagaagtggtggaaacaaatcttttattaaatcatatcaaattgtgtttctcgtttactttttccattttgtaagtcacagtcatatctgctagtttttcggaaaccttggctcacatttgtcaaaaaaacttggcttggcattcttgaggttaatgctgcgtgatcaatcggtgataaatttgacataattaactgttgtaatggcatttctgagtctgtttctcttctttactcctgctgaaatcatctgagattagttaacttctgaatatttcttcagatgtgctgtggatgcctagaaaaagagtggtaaggaagtgtcgttgatatctggagttcttatctgtccacaggttaatgatctctctgaataataacacccctatttccctaggaggatcccttcccctactctcaaggcaggtggctcagatgggcctgatttattcctggtgctaggggtgggcaaaagacccagacctgaccaatcaaaaacatcaaattgggccaaccagaacgaattagaattctgggacctttgctacaactattggaaaagataattttttttttgattggaattcctgaaagaacaagacataaacctgcttctggttatctttgctttccggggaaaggttttttttaatgtttatttttattttttctgagacagggtctcactctgtcacccaggctggagtgctgtagtgcaatcatggctcacggcaacctcggactcctaggctgcagagatcctcctgccttagccccctgagtgctggagctacaggtatgtgctaccatgcctggctaactaaatttttttttccttttttgagacagggtcttgctctgtcacctaggctggagtacaggggtatgatcgtagctcactgctccctcaacctcccatactcaagctatcctccctcgtcagcctctcaagcagttgggaccacaggcatgtgacaccatgcccagctatttttttttttaattttctctagagatggggtctcactatgttagccagtctaatctcaaacttttgggctcaactgatcctcccacttaagcctcccaaagtgttggcattacaggcgtgagccaccatgcctggccaaaaaagggcattcttgaagtcaaacaagggaaaacactgagaaatgaagggaggttcctgatcatgtcacttggataccagtgtttagccatgcctgaagtcttacccttcaattaggcaggctaatacattttcattttttgcctgagtccgtttaacttgggtttctggcacttacctcgaagaaagtcctaaatacttatgttttccaagtttcagtaaagtctcatgtatgggagagtgtggtcagcgccagcaatacccatgtccataataaaatatcagtcctctccccgtctgttattgctggtcaccactgtataatagactgtgttcaggctggagtgacagctccagtccacagttcatcagagggtctcagcccagtctcgtcaaggattctcatttctagcattcatcatggttgccctatatccatgctctgaggatatggcatttacctctgctgtgccttgtcctccccctaccttgtaccagtagatcagtagatccttatgaatgcacaaatacctctctctgcaccagagagagtccagcctgaggtttgtaggcagctagctactggaattttctcccagctttgtatctctaagatctcaggtccatttctttttcttttcttttcttttctttttctttttttttcctttttcttttcttttctttctttcttcttttttttttttttttgagacagagtttcgctcttgttgcccagactggagtgagtgcaatggtgcgattgtggctcaccgcaacctctgcctccctggttcaagcaattctccttccgcagcctcccgagtagctgggattacaggcatgcgccaccacgcctggctaactgtatatttttagtggagacggggttactccatgttggtcaggctggtcttaaactcccaacctcaggtgatccccccacctcggtctcccaaagtgttgggattacaggtgtgagccaccgttcccggcatctcaggtccatttctaggtcttgccttgccttacttgaattaggtaatgaccttatatgtgggggaagagatgatgtggacagggatatatggtctaacattcacagtgctcctactgcttatcagatactgtgcttggttcatttgtgtcatattatgttgtgttttccataacacgtaaggcattccatgtgcaagacactgtgttaagtgccttatcaagcaacatctaatttaatccttataaaaacaatagaaaggcattattatctccatatagaagctgaggctctaggttattttctttgtatcatacaatgaggaaatggcaaaagcaagatttcaactagggtctcaatgactctgaacccagttttcttacctccgacattagcacttactgtattttttttttttccaacttttattttacattcaaagggtacatgtgcaggtttgttacatgggtaaattgcatgttgcagaggtttggtgcacagataattgtgccacacagataattggcataatacccgataggtagtttttcaagcttcacccttttcccaccctcctccctcaagcaggtcccagtgtctattgttcgtttctttatgttcacgtgtactcaatgtctggctctcacttattagttagaatatgcgatattaaggccaggtgcggtggctcatgcctgtaatcccggcactttgggaggccgaggcaggcagataacctgaggtcgggagttcgagaccagcctggccaacatggtgaaaccctgtctctacaaaatataaaaattagctgggcgtggtggcaggtgcctgtaatcccagctactccagaggctgaggcaggagaattgcttaaacccaggaggtggaggttgcagtgagccgagatcgtgccactgcactccagcctgggcatcagagcgagactctgtctcaaaaaaaaaaaaaaaaaaaaaaaaaaccaagcatgtagtatttcattttttgttcctgtgttaattggcttaggagaatggcctccagctccatctatgttgctgcaaaggatacgattttattctttttttattgctgtgtagtattccatggtgtatatgtgccacattttctttatccagtccactgttgatgggcatctaggctgattctatgtctctgctattgtgactagttcacttactgtattgtctcattgatgagcatctacgtgtctctgctattgtgagcagcgcacttgctggattgtcctgttgataggcatctaggttgagtctgtgtctctgctatggtgagtagtgtacttacagtattgtcttgttggtctgtgcatccctctcacctgtgagcttcctgatctcgtgcactctgtgttatgtctggatcccgatcttcactttagaaccttgcatagagcaggttctcaaaaactgtttacagaattaaagaatctttatagcaatgtcagaaggtgagtattttctttccgttttacacatgagcaaatttaggcttaagaaagttaagcaaattacccaaggccaggaagtagaattcatgaaatataatccagaaatttccaagagaattgagaaagatattctctaagctaaagaggagggtttttgttatttttcggcattctaatataggtagtttatgtggaaacatggaagtaatttaccacctttcttaatgaaggccctactaggctgggctatcatgaagaaaacagcacagacatttttatgaaagaaaactacatctatgttactgcatctgtatttgagctccttataacatgtaagcaggcagaacattgtttaatgttgctggacaaagctcaagtgaaaatgatccagtggggaaatcttttatggaaattaaactgattgttttggaatgtaagttgcaatttttcacttcttagtttctgctctcttgagtccttgtctatgtcatgaacacatttgatacggaatcctggggactttgcccattgtaaggagcactgtagtggaaggcagtcgagctcaatgtatagagagaggcagcaaggtgggtaagtagaggcagcacctgggacccagctagatggactggtatctctaaagagtgcctcaaggaaacacatttcctggagcacttcagaacatgagagctgaggccaggatctggtgcagctcactctatctgaaagcactgagattctgttaagctaatgatgagttttctcttcatctttcctcccaacaccaagaccaagcaaaaatgcaagggaacaaagaacaagaagcagtgtccaaagtcttcagagtctctaggatagttgttgacctaagtcacactgctgtcatcctctgggctgcttgtacttttggagtagtcactggcagattaataagtttcctgaaagttaacagaaaataccagcttaaagtagtactaaagttttcaaaaaatttttttggggggaggatgagagggtgaaatatgatagtcaccctgatgtactcatggaagcatctaggttgtgttattagttaaaattcccagccatgaagacaagaatacatggaattcacccatgtgttcacccaacctcccatccatccacctatccatccatttgtcatccatccattcatccattcttccatccatctatccattaatacatctgtccgtctacctactcatctgtccatccgtccatccatccacctactcatctatctattgtccatccattcatccatccacttacccatctatccaccatccatacacccacctatccatccacccatccatctactcaccaatctatctaccatccatctatcaattatccatccacccacccatccatctacttagcaatctatccaccatccatacacttcacccatccatcaattcacccatcaatccatttacccattcacccacccaccatccatccatctatccatctatccaccatccattcatcaatttaccctatatccaccattcatatacctactctttgatccatccacctaccaatctatccattcatccatccacacacccacctattcatctatccatccatctacccatctgcttaacattaaccaagcatacataatgtgccaggcattgtctagggctaccaacacttggttcttaggaaattccaagactgcatttttttgctataaaataattttggaagtcaaatttgcctgaggagttttgttaaagtgaagcaaaatgtaatatgagtttatatagattttggctcttacataactatacttggcattgaaaactacgcaacttattcaggaataggtggtgtatggtacaagttgctgtatcatgcaaaaagatgggctgcaagaaacagtttttgtttaggctttgtttttcattaaaatctgtgaaattgttgagctcaagttgttgttttgcttggtcaggtgttgctagtcagctaaaaataagtctgtatcagtgatcgtcttagattctaagaaaactcagatgtgagggaaattaatgtgcttgcactttttgttacatgacaccatgttgaacatgcgtagagttttgtgaacagaggtggtagagcgtgttggtaagagttgcatagttggtaaaagagttttaaaatgtgtttctgattaatttacataaataatttggggccaaaaaccttctttccctccactcaacaccatatttttgaaatcccttcatgttgctctatataaatctagttaatttctgattgtgtcctaaagtcaacgtatgcataaaacacaatttgcttatccattccttgagtggttattgtataggaacatcaaagtctgtgtcgtcacaagcaaaactatggtggacatcctaatgcatgtgttgttatggccttgtgcaaatttctctagtgcacgtatatatccagatatgggattgttgggtagatgaatagttaattgcactgagtactgagaaattgttacttagaatggctgcttggtttacactttttactagcacttgatgttctctggcgttgtaatttttaccaatctgatggctgtaaagtggcatatcattgttgttttgatttgcttttctctgattattactgatgttgagtatctcttcatatacttattagccattagtgtttcctcttctattaattttattttcgtaggctttgcccatttttttctattgggtttcctgaaattttcttgctattttcaggagtttctctcaatattaatgccagtttcattttacacactgaaaatatcttctcacagtctaccaacgtgttaaacgtgtagatgatgtccttttctgagtagaaacctcaattgtaatcttgtcaaacacttcatcttttcccgttatggcttgttcttttaagtcttgctcaagaacctgctcaattctaaagtcacaaagatatttcccacattttgtttgattacttttatgatttacctttcacattcagatgtaaaggaaaaaatccaatttaatccttgtcatacagtaaaccatcctcccccaaacctaccaagttatttattctttcccaactgggttaagacaccatgtctcctatgtatgtggggatgtttctggaatctctatactgcttcaatgatctatttagctgttcctaagactgtagcacagttttttattattatactttaagttctggggtatatgcgcagaatgtgcaggtttgttacataggtatacacgtgtcatggtggtttgctgcacccatcagcctgtcgtctaaattaggtatttctcctaatgctatccctcccctagccccactgacaggccctggtgtgtgatgttcccctccctgtgtccatgtgttctcattgttcaactcccacttatgagcgagaacatgcggtgtttggctttctgttcttgtgttagtttgcagagaatgatggtttccagcttcatccatgtccctgcaaaggacatgaactcatctttttttatggccacatagtattccatggtgtacatgtgccaaattttctttatccagtttatcattgatggcatttgggttggttccaagtctttgctattgtgaacagtgctgcaataaacatatgtgtgcgtgtgtctttatagtagaatgacttataattctttgggtatatccccagtaataggattgctgggtcaaatggtatttctagttctagatccttgaggagttgccacactgtcttccacaatggttgaactaatttacactcccaccaacagtgtaaaagtgttgctatttctccacatcctctctagcatctgttgtttgctgactttttaatcgccattctaactggcatgagatggtatctcattgtggttttgatttgcatttctctgatgaccagtgatgatgagcattttttcatatgtttcttggccacatacatgccttcttttgagaagagtctgttcatatccttcgcctactttttgatggggttgtttgtgtttttcttgtaaatttgtttaagttcttcctagattctggatattagcccttcatcagatggatagattgcaaaattgtctcccattctgtaggttgcctgttcactctgatgatagtttcttttgctgtgcataaactctttagtttaattagatcccatttgtcaattttggcttttttttgccattgcttttggtgttttagtcatgaagtctttgcccatgcctatgtcctgaatggtattgcttaggttttcttctagggtttttatggttttaggtcttatgttaaagtctctaatctatcttgagttaatttttgtataaggtgtaaggaagggatccagtttcagccttctgcgtacagtagccagttatctcaacgccatttataaaatagggaatcctttccccattgcttttgtcagatttgtcaaagatcagatggttgtagatgtgtggtgttatttctgaggcctctgttctgttccattggtctatatatctgttttggtaccagtaccatgctgttttggttactgtagcgttgtagtataatttgaagtcaggtagcatgatgcctccagctttgtacttttgcttaggattgtcttggctctgcaggctcttttttggttccatatgaaatttaaagtagtttttttccaattccgtgaagaaagtcaatggtagcttgatggggatagcaatgaatctatccattactttgggcagtatggccatttccacaatactgtttctttctatccatgagcatggaatgtttttccatttgtttgtgtcctgtcttatttcgttgagcagtggttagtagttctccttgaagaggtccttcatatcccttgtaagttggattcctaggtattttattctctttgtagcaattgtgaatgggagttcactcatgatttggctctctgtttgtctgtacttggtgtataggaatgcttgtgatttttgcacattggttttgtatcctaagactttgttgaagttgcttatcagcttaaggagattttgggctgagatgatggatggggttttctaaatatacaatcatgtcatttgcaaacagacaatttgacttcctcttttcctaattgaataccctttatttctttctcttgcctgattgccctggccagaactttcaacactatgttgaataggagtggtgagagaggacatccttgtcttgtgccggttttcaaagggaatgcttccagtttttgcccattcagtatgatagtggctgtgggcttgtcataaatagctcttatgattctgagatacgttccattagtacctagtttattgacagtttttagcatgaaggggtgttgaattttgtcaaaggccttttctgcatctattgagataatcatgggatttttgtcactggttctgcttatgtgatggattatgtttatcaatttgcctgtgttgaaccagctttgcatccccgggatgaagccagcttgatcatggtggataagctttttgatgtgctgctggatttggtttcccagtattttattgaggatctttgcatcgatgttcatcagggatattgacgtgaaattttctttccttgttgtctctgtcaggtttttatatcaggatgatgctggcctcataaacgagatgggaggattccctctttttctattgtttgcaatagtttcagaaggaatggtaccagctcctctttatacctctggtagaatttggctgtgaatccatctggtcctggacttttttttggttggtaggctagaaattactgtctcaattttggaacctgtgattggtctattcagagattcaacttcttcctggtttagtctttggagggtatatgtatccaggaatttatccattttgttctagattttctagtttatttgcgtagaggtgtttatagtattatctgatggtagtttgtatttctgttggagcggtggtgctatcccctttatcattttttattgtgtctatttgatttttctctcttttctgtattagtctggctaatggtctagtttgttgatcttttaaaaaatcccgctcctggattcattgattttttttttttttgaagggtttttcgtgtctctctctccttcaggtctgctctgatcttagttatttattgtcttctgctagcttttgaatgtgtttgcccttgcttctctagttcttttaatagtgacattagggtgttgattttagatctttcctgctttctcttgtgggcatttagtgctataaatttcgctttaaacactgctttaaatgtgtcccagagattctggtacgttatgtgtttgttctcattggtttcaaagaacatctttatttctgccttaatttcgttatttacccagtagtcatttaggagcaggttgttcagtttccatgtagttgcgtggttttgactgagtttcttaatcctgagatctaatttgattacactgtgatctgagagactgtttgttttctgttcttttgcatttgctgaggaatgttttacttccaattatgtggtcaatttgagaataaatgtgatgtggtgctgagaagaatttatattctgttgatttgtggtggagagttctctagatgtctattaggtctgcttggtccagagctgagctcaagtcctggatatccttgttaatcttctgtctcattgatctgtctaatattgacagtggggtgataaagtctcctactattattttgtgggagtctaagtctctttatagatctgtaagaacttgctttatgaatctgggtgctcctgtattgggtgcatatatatttaggatagttagcttttcttgttgcgttgatccctttaccattatgtaatggccttctttgtctcttttgatctctgttggtttaaagtctgttttatcagagacaaggattgtaactcctgctttttatttttgctttccatttgattggtaagtattcctccatccctttattttgagcctatgtgtgtctttgcacatgagatgggtctcctgaatacagcacaccaatgggttttgactctttatccaatttgccagtctgtgtcttttaattggggcattttgcccgttcacatttaaggttaatgttgttatatgtgaatttgatcccgcctttatgatgctagctggttattttgcccattaggtgatggagtttcttcatagtggcaatggtctttacaatttggtatgtttttgcagtggctggtaccggttgttcctttccatgtttactgcttctttcgggaggtgttgtaaggcaggcctggtggtgacaaaatctctcagcatttgcttgtctgtaaaggattttatttctcctttgcttacgaaacttagtttaactggatatgaaattctgggttgaaaattcttttctttaagaatgttgcatattggcccccactctcttctggcttgtagggtttctgccaagagatctgctgtttgtctgatgggcttccctttgtgggtaactcgacctttctgtctggctgcccttaacattttttccttcttttcaaccttggcgaatctgacaattatgtgtcttggggttgctcttctcgaggagtatctttgtggtgttctttgtatttcctgaattgaatgttggcctgtcctgctaggttggggaagttctcctggataatatcctgaagaatgttttccaagttggttccattctccccatcacttttaggtacaccaatcaaatgtagatttggtcttttcacatagtctcatatttctcggaggctttcttcatttcttttcattcctttttctctaatcttgccttctcgctttatctcattaagttgatcttcaatatctgatatcctttcttccacttgatcaactcagctattgatcctttgaggagaagagatgttctggtttttggaattttcggtctttttatgctggtttctccccattcatggatttatttacctttggtctttgatgttggtgactttcagatggggtctctgagtagacatcctttttgttgatgttgatactattcctttctgtttgttagttttccttctaacagtcaggaccctctgctgcaggtatactggagtttgctggaggtccactccaaaccctgtttgcctgggtatcagcagcagaggctgcagaacagcaaagattgttgcctattccttcctctggaaacttcctactagaggggcacccaccaggtggcagccagagctctcctgcatgaggtgtcttttggctcctactgggaggtgtctcccagtcaggatatgtgggtgtcagggaacaacttgagggggcagtctgacccttatcagagcccagatgctgtgctgggagatccactgctctcttcagagccatcaggccaggacgtttaagtctgctgaagctgtacccatagctgccccttctcccaggtgctctgtcccagggagatgggggttttatctgtaagtccttgactggggctgctgccttttttttcagagatgcccttcccagagaggaggaatctagagagagagtctggccacagtggccttgcttagctgcggtgggttctgcccagttcaagcttcccagcagctttgtttacactgtgagggtaaaaccgcctactcaatcctcagcaatggtggacgccccttcccccaccaagctcgagcattgcaccttgagctcagactgctgtgctggcagtgagaatttcaagccagtggaccttagcttcctgggctccgtgtaccagtttttgaaattattatggcttagtaataggtcatggtatttagtataatgaatccttctccaatttttcaaaactaccttagatattcatgctttttatatttttacatacattttaatatttgtcaaagtcctcaaattgtgctggaatcttcattttttattttttattatactttaagttctagggtacatgtgcacaacctcctggtgtgccgtttgctaaggccgttagaaaagcgcagtattagggtgggagtgtcccaaatttccaggtaccatctgtcacaacttccctttgctaggaaagggagttccccgaccccttgtgcttcccgggtgaggcgatgccccaccctgctccatgggctgcacccactgtctgacaagccccagtgagatgaacccggtaccccagttggaaatgcagaaatcacctgtcttctgcatcactcacgcggggagctgcagactggagctgttcgtatacggccatcttggaacctcccccactggaatctcgattggaactgcattaaatccatggattaatgttgggagaaattaatattcttacaatgttaagttatcctattcatgagtacggtgtttgtcttaacttattgaggttttttaaaatgttctttataagagctttacttttctccatgaagttctagtgcattcatttttaggttaatttcttgatatgttatatatataacagagtgtttaaaaaatgatctaactatatatatgtaaacatgatagcaactacatatagttatataactataactatatatagttacatgactataactatatatagttatataactataactagttacataactataactatataactgtatatagttatataactaactatatgtctgactatatgaatatgtaaaaataggtgtatatatatataatcctaacaatatagttatatctatatatctataactacatatctatatatctgtaactacatatctatctatagatatataactacatctaactatatatagttatgtaattatatatctaagtataaaatcatatatagttatataactacatgtaactatatagttttatatatatatagatatagcaactatatctatatataactacatatatagatatagttgttatcatgttttaagcactctgttccatgcctggtatgtagtgagtacttaataaatggtacttactcttatttttgtaactattataagtgggggaaaagcaaagagggatactctccaaatgtctttaggagtcgtcatgatatgctggaaataacatggttgtggaatcattctcatgtgggttctggtctgtctccaccattaactgtgtcactttgaacacatttctcaaacttatacaatgggaatgatgcttatcctactggtgttctaggtatggtgagaagataaaatgagatcacaaactagtaatgaatactatgattggcacacaaaagcactcagaatgcaggtccttttcttctctagtgaagatctgataagtttgtcaaacagcaacaccattcccccacaaaatactcttttcttcatttgaagtccatttccaaaatttgtcctttcagatggatacagagagcaggtacacagattaagaaaaattgaaaaatttatccttccaagcatccccttttcaaagacacctttggtttttcatctttagaatgtaaactccttgaggacaggaagtgccaggaactccacacatccattcctgtcctgtggtttacccatgccagtcatggtaagcccatcacccttgtcagtgattggctcagggatgggttaagcccatgccagtctgggccagtgagattctaggaggaacttgatgaccgcttctggagaaggacatccagttttcctctttgacatccagttttcctctttgactgtatgtgagttaaagaggcccatgccccagtttctgctggcagtcaccttatatcagtgagggaagccagccttaagatgaagcccacattgtggaaatagagacagggtgccatgagcagagaaattctgggtttctgatgtcagcattgagctgctgaatcaatcaatgaagacaccttcccctttcaatgctctattatcataaataatgctctttttgatttagtcagttgtttttttttgttgttgttgttttttgagacagagtcttgctctgtcacccaggcttgagtgcagtggtgtcatcatagctgactgcaactttcaactcttgggctcaagcgatcctcctgcctcagcctcctgagtgactgggactacaggcatgagtcaccatgcctgggcaatttttaatttttattttgtagagacaggagtctcattctgttgcccaggctggtctggcattactgatcttaagcaatcctcctgcctcagcctcctgaagcattgggattcctagcatgaaccactgtgcctagccagtttagttagttcgagtaagaatgtcttttatttgcactctaaaacatcatagtggattcagacctaaagtctttgtcctgagcctgcaaataattgaggcttaagaaatgtatgatagtgaacacgaacgtgggaattatactggctttgtagagtgtagtgcattgcataatactgtgttctgtagattctttgagcttcctaatggccttttaatacagaatgcaattccttttcctctttagtgaagatacggatttactctcatctgtctctttcaggtgaggtaactgaggatcaaagagggtttgtgatatgctgaaatttgaatagatagctaagcagtccagttgtgataagaacctaagtcttttcactccttctttggtacattttctcatatgctcaatccccactaggctgtgagagccttaagggtgaaagctacaatcttacatatttttgtcaccagaatgcctagcagacagcctgtttcttttgggtcacaagtaatagaagaataaacacataaatgacttgttatatcttgaaagcagctttcatgtaaaggcagagggaatgatacctccttccaaagtgttttaacaatgtccagtggtgacaatgtcccatttcaaaggcaatagtcctgggtgtgttttgtccttggtatatctgtagatccagccttttagcacaggtataacaggcaatgatgccattgcaaaggctgtactgactagtgaattctttcagacacagaggaggaaggagtcaaacagcaaagtcagaagaggtagtttagagctgtcatcccgggtgctcctgggaggaatttgcacttaacacgtaaatcaggttcagggtctgtctaattaatacaacgactttagtgccatttgcttccccgtcagaattcatactgaattctgacacatggtcattgggtttatcaataatgtgccccataaatccagttagcattttcttctgggtgccgcaccttgggaagctgcttaaataccttgaaggtccttatctagctctggccttgaatctcaagaagggtcagaggcccttcaagctcttcactgagtatgacattactgctgtgatttgagtcctttgtgcctggctggaagatgttctggtgaaagatcttaaagcttagatgaggaggttacctcccaccaggctttggcattcttagaaggagtcctggtgctggggggagtgtctagatttgtcactggttgtttctgtttgctcagcatcacttcctttggtgaactgcccctcacctgtgcaacatgactctataggcctgccatctatgaaactctaccccaggctgcagagctgggtctgtaactcaatctggtcaatccaagcgctctctctcctgggaatctgattcttgagctgagacacacaagggtggaggtgatttatgcaaagccacttacttctgaggctgttcatgagtctctactttcaaactccccttcatttctatgaccttccaaatatcccttcaataaatatttagttcttgtttgcatgtgttagggtaggtttctgttacttgcttttaaatacctttaagttatacagatgtagatagtacatgatagtttattatttttgtttcccaaaatgaaaatacgtttgttgaatgttctagtaatggtggtgctattatcttcttcttattaatatcttattaatatatatcatatattattatataatatatattatatataataatataatattaatatataatatataatgtataataatatataatatataatgtataataatatataatatataatgtataataatatataatatataatatataatatataataatatataatatataatatataataatatataatatataatatataataatatataatatataatatataataatatataatatataataatatataatatataatatataatatatatagtataatatataatatataataatatataatatataatatataataatatatatagtatatataatatataataatatataatatataatatataatatataatatataacaatatataatataatatataatatataataatatataatatataataatatataatatataatataataccataccaaatgtgtatggtaatacatacaccatacactaaatgtgtatttaccatacaccataatatataatatataatatatataatatataatatatattatataatatatataatttatatattatatattatataatatataaattatatatattatataatatataatatatgttatataatatatgttatataatatataatatatgttatataacatatatattatatattatatatattatatattatattaataagatatatattgtggttatatataatatatattatatataaccacatttggtgtatggtaaatactcaatacatgtcaggccctgattgttacatgttttggctaaaaaagaaatgtggtttcattgagctgatataacttgcttaagagaaaacagctggccaggtgtgatggctcacgcctgtaatcccagcactttgggaggccaaggtgggtggatcacttgaggtgaggattttgagaacagcctggccaacatggtgaaaccctgcctctactaaaaacacaaaaattagccaggcgtggtggtgtgcacctataatcccagctactcctgaggctacggcaggagaattgcttgaacccaggaagcggaggttgcagagagctgagatcacgtcactgtattccagtctgggtgacagagcgagattgtctcaaaaaacaacaacaaaaaaagcaaacagctatgatacaatgggagctggtattaaataaaataatgcttgtgaagtgcccagcactgagcctggcacatatagcattctattctttatttattttattgtattttattttattttttgagaccgagtcttgctctgtcacccaggctggagtgcagtggcgcgatctcggctcactgcaacctctgcctcccggagccattctcctgcctcagcttcctgagtggctgggattacaggtgcccgccaccacgcccggctaattttttgtatttttagtagagacggggtttcactatgttggccaggctggtctcgaactcctgacctcgtgatctgcccacctcagcctcccaaagtgttgggagtacaggtgtgagccaccgtgcctggtctagaatgatctttaaattgcagctgctgttattcttttaagcggctcattagcccacatttgggagggaggtgtgtagaaacaatgccgcaggaaaaactcagatcagttagtcagtctccccttcctctgctatcgcctcatatgtcttccttttcctcccccttccagagtccctatcaggccccattccagataatccctgctgctctgctaagtgataactgagctattagctggtgtttaagataaagcctttcctaaaccatttgcatttcagtggggaaattcctgagaacctagtggctccctcattcaaagcatttagggggcattgctttctcctctagggagaccgtgaagatgtctctttggaagagttactcatccgtgctgaggtctcactaattaacatcttgcctcaggagggccagtgtgcctgaacaatgctttctactgatcagttctatagtgggttaccacaggcactgtatgattgccacagtagggggaaccatcgtcaagggcagatccttatggaattggaatattgcaatataggggtatttgtgtatgtgtgtgtgtgtaataaataatttagtcccaggtagtgccattcagtatattaacacatattatttatttctgttttcacagcagtcctaaaagttccgtattatttccccactttgcagatgaagaaattgaggccctttagtgggtattggggctctgctgttttccctcatccaacattctccttcccccttcttttgttattagcatatagctcacagtatagttgggatttgtgttcctgcccaaatctcatattgaaacgtaatccccgatgttggaggtgggacctggtgggaggtgattggaacatgagggcaggtgtcacatgatggtttagcaccatcgcgttggtgctgtcctcacaatagtgagttcttgtgagatttagttgtttaagtgtgtagtacctcccccttcttctcttgctcctcctttccccatgtgaccttcaagatccctctctgccctccgccatgattggaagtttcctgaggcctctccagaagtagatgctggtgttatgcttcctgtactacctggagaactgtgagccaattaaacttctattcttataaattacacagtctcaggtatttttttttaaatatagcaatgtgaggatggactaatacagctgatgtgggaccgatcctccctgctcttgtgtctgagaactgactaatctaaataatctacaccactggccactgggattggttcaggagtagacatatgaggccactgagagccagacttgggacttttgtaggagatgtaggaatgtgccttttctgacttagtggggctaagaaagcagaatgagcctagaggagacaggggcagtctttgcctacgtgagaataaaaccaacaccaaggaaacagaggtggaaaaagaaagcgtggtttcagttgttacaacatgaacatctgaatccagacgtgcccaacgctagaatattcctgggcttttcggtttgttgatccacacatcctgtttcatgcttaatccaatctttgatctgggtattctgtcacttgtaactgaaagaatcttcatgaagacagactcggagtgttaaggaatcaatgttagtgtccctgaaaaactcatacgttgaagccctagcccccagtgtgatggtttttggaggtggggcttttcagcagtaattaggttaagatgatatcatgagggtaaggcccaaacaatgagattagtgtccttataggaagaggaagagaccagagctttctctctacaccacgtgaggacacagtgataaggcagctgtctgtaagacaggaagagagccctcactaggctcactttggcaccttgatctcagattgtcagcctccataactgagaaatcagtgtctaatgtttaagccatacagtttatggtattttgttatggcatcttgaattgactaagagaggataagtgcctcgtgtaatgtcacacaactaataagcagcagagctgggatttgaactcaggtgttgctgacttccaagtccatgaagtctccacggaaatatgagctctggtggcaaaagaacggatggagcagatgccaacattagtttcagcctggagaagaaaacctggtgatatggtttggctgtgcccccacccaaatctcaacttgaactgtatctcccagaattcctatgtgttgtgggagggacccagggaaaggtaattgaatcatggggacccatctttcccttgctattctcatgatagggaataagtctcacaagatctgatggttttatcaggggtttctgcttttgcatcttccccattttctcttgccaccatcatataagaagtacctttcacctcctgccatgattctgaggccttcccagccaggtgccactgtaagtccagttaaacctttttttcttaccagtcttgggtatgtctttatcagccgcatgaaaatggactaatacacctgggcttgcaaggggtttggtagtgggctcggggcagctaggttacctggaaaggaaagagacggcctttgaaatacaacctaattcacttcaccactttacttagttgagtgttgcttgaacttctgttgctaaactaactaaaaattgctgttttttagtgcttaccagatgggaagcactgtactaatatctttgcaaacatcatctcgttcagtcatccaaatcaccctaggaaagagataccattatctctttttgaatgactttgccagagttacacagacagtcagtggcggagctgggatgaaactgtttaggactgagtcgtgttcccccaaaattcatatgttaaaaccctaacccccaatgtaactgtatttgaagagattaccttcatagacttaatcaacgttaaatgatgccattatggtggggccctaatccagtaggactggtgactttccaagaagaggaggagacacccgagttctctctctttccttgcacacacaaagaaaaggtcatacactcagcaagaaggcagacatccgcaagggaggaagagagatcacattagaaacttaattttccagcaccttgatcttgcacttcttgcctctagaactgtgaaaaaattaatttctgttgtttaagccactcaagttgtggaattttattatggcattccaagtagactaacacagaacccaagcctacctgggttcaaatctcatcttcttaaccaccacatgggattgctaacatccacctacccatgcacaaaaatttaacatatgaaaagatctttacagagcgtggcctgggggtggggctgcttcttcaaaagggctagaattggtcctggagtcctaaagctagaaggataagtgcaaagtcatatctacttggcagaatgaatccaaacctttcagcaggtgcaaactaatgttttcagctctgccatcctttctgtcgtatgggctagaatataaaacagctcagcctcatcaagagagtacaatgaaactctttgctgggaaaaggatagctttatttctgttaaagggccacattgagagcctcagaagcaactctccttgcaggacaaaggaaaaatattagagtgatgaattagttccttacaacccaatgacagactggtggataaatgcagtgacagaccccaaattttatctttctgcaagtctgccccaaataaaaagcccttatccttatagacactctctgaaaatgggattaaaacatagcagaatgccccactgtctgggtgacatttgttattattattgctgttaagtaagagccagggtttaggtgttaaaacccaagtgtgcggtaattacggtaccactgaggctcagcacaatatgcttcctgtgtctctcttgttttgatagctggctatattggcaagaggcatataccactggggctcaataaggtttagggctgtcctgttctgactaactccctttgtggcccaaataacactataaaaatcaacatgggaaaccttccttttttttctcctaagaaacgcctgcacaaaagccttatttttctgccttgaaagtgtttttaacttaaacgccaatttaattctggaaattgtctgtggagggccaagtgcattattatactctctgttatgatgaggataggaggatgcaggaggtgccatcagtggttatgacatctacatctttgaatcaggggttgtcaacactggtcatacatcggaatcaacttgggagcattagaaaagtactgatgcttgggtcctaaccgagatattttgattttcttggtcctggggtgcaggctgaccaatgggattttatttaaagtgtcctgggttattctgatgtgcagccgtactggagatccacttctttaaaccagttttagagttcagcattttccccataaacagcttaaagtataggaagtaaatggtatatgctatggtttggatgtgtttgttgttgttgtttgtttgttttttgagacggggtctccatctgtcacctaggctggagtgcaatggcgcgatctcggctcactgcaacttcggcctgccgggttcaagtgattctccagcctcagcctcctgagtagctgggattacaggcatgcaacacacacctggacaatttttgtaattttagtagagacagagtttcaccatgttggccaggctagtctcgaactcctgacctcatgtgatccatcttcctcggcctcctaaagtgctgggattacagcggtaagccactgcacctagcctgggtgtattttttttccccctgaaactcatgttgaaatttgattcccagtgtagaggtattgggaggtggggcctagtggaaagcatttgggtcatggggtggatccttcatgcatggcttggtgctggtactgcgatagtgggtgggggctggctttggtgagactggattagttcccttgagtgtggattgttataaagcaaggacacccctcatgttttccctctttgcacgtgtctgtttcctttttcaccttctgccatattgtgttgtggtgcaaaagccctcaccagaaacagatgccggcaccatgcttctttaacttcccagcctgcagagctgtgagccaaaacaacctttttactttataaattccccagcttcaggtattctgttacagcaacaaaacatgaattaagacagtgtctgtgctgtgtagataaatgtactgtgtgacttttgacaaattacttgacctctttatgtttcctcaattttctcgcctatacaattttggtaaaagaaatgcctaattcataagtttgtggtgagggttattaaatgaagtaattaatgtgcctggcagagaatacacatttgataaatgttggctattattattactgctattgttactatcacctgttagatgataaaccagaaactagtaaactagaaactagttttatttaaaaaaaggagggggctatttactgattcatgtaaacaaatctacgaaggggtaagggtagatctggtctcaggacaactgggtccatggactcaaaaccatccattgtttcttgctgtttctcattttgcttccttctctcatgttagcttcaggcttggggaccagcttttctgcataggaagaagaggcattatatcagactgacctggcacacattttatgtccagaaaggaaaaagggattttctcaccaggttctgctggggaaaaagacctgaggaaagattgtccagaattgagtcatatactcattagtgatctgtccactgtggctatggaggtgggatcttctcccagagggaggaaaagtgaggtgcctagaagacaaaaataacaaccgctacaatgatgaaaaaccagttctaataagaatgactatcccttccacaaatatttattaagcatctaacaggagccagacatggttctatatactactttataagatgagaaatggacattccattaaaaaaataccgaagtatagtttcgtacagtaaacttcacccattttttgagatataattcacatacagtaaaattcgaccttttaaagacatgtaatattttatcctttttggtgctatagtagaggtagtaaattttggaattgggaagtgttaggccttcaactttctttttttttttttttttgtaaaatttgacaaataatcatgtttcactaccacaattaagatatagaatatttcaattatcccttaaattgtcttgtgtgtctttgaagtccacccctttgtcttctccctgcctatggcaaccattgatctgtttttttgccactctagtttgccttttgcagaatgtcatttaaaaggaatcatacagcatgtggcctcctttcacttagcatttgagattcatacaaatcgttgtgtatatggatagcttcttcctttttattactgagtagtagtccatggtataggtatgctgctgtttgtttatccattcaccagctaaaggatatttaggttgtttccaagtttggagtgattgtgaaaaagctgccagaagacttgcatacaaaattttgtgtaaacatacattttaatgtcatttggtaaatgtctgggagtgaggatgctgaatcatatggtaagtgtatgctaggctctataagaaattgccaaaatgttaaagtggctgtgacattttgcattcccattcacatgcatgagagttatggttactttaccttcttaacaacatacgatattgtcagtttttaaggagggcattctgataggtgagtagtggtgtttcattctggttttattaataactaatggtgctgagcttctttttgggtgctaatttgcaattcatctgctttcttcggtaatgtgtgtgttcaaattgtgtgtccattttttgagttgcttgtttcttattattgaaatttaagtgtcctttgtatattctgtatataagtccagatatcaggtatgtattttgaatacattttttcccagtctgtggcttgccttttcattctgttaacaatgtcttttgaagagcagaaattttacattttggcctagtcaaattgatcaatttttaaaaattcatgaattatgtgtcgtatctaaaacacctttgcttaatccaagattagagagattttctccacttttttctagaaatgttataattttaggtctatatttgggtctatgatcccttttgatgtaattattgcagattatgtgatgtataggttgaagctcattattttgcttatggatgctgctgtgatttgaatgtgtcccccagagttcatgtgttgaaagctaaatccctaatgcaacagtgttgagagatgggaacttaaaagatcattaagaggctaggtgtagtggctcacacctgtaatcccagtgctttgagaagcccaggtggtgaatagcttgaggctggaagttcaagatcccatctcgacaaagcaaagcaaaacaaaacaaaacaaaaattgccaggcagggtggtatactcctgcagtcttagctattcaggaagctgaagtaagaggatctcttgagcccaggaattttaggctgcagggagctgcaattgcatcaccacactccaaactgggtgacagagtgagaccctgtctctaaagaaaaaaaaaaaaacaaaaaacgtgatcaggtcatgtgggctctgctctcatgaatggactaatgctgtcattgtgagagtgggtttgttattgtgggagtgggttcctgataaaagggtgggtttagccccctttcctcccctttttgtgcctgctcttttgtccttctgccttcggccacaggatgatgcagcaggaaggcactgccagatgtaggccccttcatcttagacttcccagcttccagaactgtgagaaataagccttgtttttaaataaactactcagtctcaggtattctgttacagcagcataaaacagactatgaaagatgttcaataattatttcagtataattgaattgcttttgcacctttgtgaaaaataagctgaccatatttgtgtgggtctatttctgaactctattctgttccattgatctatgggtttttttcttcatctatactatgtagtcctaattacggtagctttatagccaatcctgaaatcatgtagtatgagttcttcaacgttgttcatctttttcagaattatttttgaattctatttctgttgcctttctatttaaaatttagaatcagattgttggtttctacaaaaaaaaacttactgagggtttgatggaattgcattgaattagggagaattggcaacttaacaatattgaatatttcagtccatgaacacataataggtttctatttaggtcatctttaatttcttttatcagtctttgtagttttcaccacacagatcttgcacatatttttttctaaacgtttcatgtcttttgatgctatggtaaatgtaaattcaaaattagaaatataggtcctccagctttctttttttcaaagccgttttgtctgtttctggattctttgcttttttacatacattttagtattagctttctggaaaaagcctgctgagatttttataggagtggtcttgaatctatagatcaacttgagaagaattgctaaaaataatattgagtctttcaatccatgaacatgggatatctatcaatttatttaggtccttttacatttttgtcagtaatttttgtagttttcagtgtacaagtcttgcacttcttttgttaaatttattcctattttattccttttgatgctgttgtgaacagaattgtcttcttaatttcattttcagattgttcattactgatatatagaatacaattgatttttgtgtattgattttctatttcttcttgagtgtgctttggaagcttatgtttttcaagtgatttgtctaagtggttgaatttattggcataaagtcgttcataatattctcttgttctatcttaatgtctgcattatctatagtggtgtcatctcttaaattcttgcttttgataatctgtttcctctcattaatcagtctggctaacggcttattaaaattattgattttttaaattatactttaagttctgggatacaagtgcagaatgtgcaggtttgttacaaaggtatacacatgccatggtggtttgctgcacccatcaacccatcatctacattaggtatttctcctaatgctatccctcccccagccccccaacccctgacaggccccattgtgtgatgttcccctccctgtgtccatgtgttccccttgttcaactcccacttacaagtgagaacatgcagtgtttggttttctgttcctgtgttagtttactgacaatgatggtttccattactgggtatatacccaaaggattataaatcattctgtaaagacacatgcacacatatgtttattgcagcacaattcacaatagcaaagacttggaaccaacccaaatgcccatcaatgataaactagataaagaaaatgtggcacatatacaccatggaatactatgtagctgtaaaaaaggatgagttcatgtcctttgcagggacatggatgaagctggaaaattgatcttttaatgcaccattttttttctcaagtgtttttctcttttcaactttattgttctactcttatctttattatttactttctttcgcctgacttggattttatttcttttactttttttttctagttttttaaggtggaggcttaggctacgatttgagacctttcttattttcagacataagtatttaatgatacagaattccctgtaaacattgtttatctgtgttccacaaaccttgatatgtcaaaatttcttttttattaaattcaaaatatttcctaattttcattgtacctccctatttaatccacgggttgtttagaactatgttacttaatttgcaagtattttgatattttctagatatgtttatattattggtttgtaatttaatctcacatggttgcagaatatactttgtattatttcagtattttaaatttgttaaagttgttttatggcccagaatatcttgctgaatggttcatgtgaacttgaatagaatgtgtattctgttgttgttgagtggaacattctgtaaatgtcaattagataaagttggttcatagtgttgtatatccttgctgattttctatttcttctgtcaattactaagagacaaactgtgaagtctccaagtgcaaatgtctatttttttagttccataacttttttgcctcatgtgtcttgaagctcttgtattaagtacatatgtattttcaatggttatgtctttttggtgaattgattcctttatcattatataaagtccctttggtaatatttcttgttctgatgtctactttgatactaatataaccactccagatttcattttgttgtgttttaaaactattattttaaataaatacatggttttggatagcatttccatggtatttgtagtttcattcttttacttttaatgtatttatatctttatatttaaagtaggttccgtgtaggcagcctatagttgggtcttgctttttaaaattcaatctgtcaatctctgtcttttaatgtgtatttagaccatttacatttattatcattattaatgttgggttaaaatacaacatcttattagttgggaattattattgatgtgctttctttttgttacatctgaatcttctgtgattctccaaatggtctctgctgagctgtggcaaacagaggggaagaggttattccattctgaagagtgccagtgccagtggggtctctagtagaggtcagctatgcccagcctatggcactgccacctagatctcaagcagcagaaacagcaatgtggcagactgacaaaatggccagttattcaacaaatcccttgatgagtactgtctcattaacatggtagatacaatcattataccaccagtgtacagatgagaaaattgaagctcagagagactaagtgatctgaccaagattatgcagtggcagagctaagatttgagcccaggtccatctgaatttgaagtttaacatcttattcactatgtggacaggctatagatacataatttgaaggcatacgttaatgatcttaatccaaattgttatcaatatgtaagttgaaggatgtaattacattttcaacctcgtgaggggtttgtgccttcaaggtaagataacacaaacctgttacctgttggatattatctatttaaagtggctatttttaaaaagatgaaagataacacatgctagtgaggatgtggagacattgagacccttgtatgctgttggtgggaatataaattagtacagccattatagaaaccagaatggagtttccacagaaaaattaaaaatggaactaccatatgatctagcaatctccctactgggtatatacccaaaggaaatgaaatcagtatgttgaagagatatctgcactctcatgttcattgcagcattattcacaacagccaagatacagaatcaacctaagtatccattaacagataactagataaaggaaaggtggttatgtatacacaatggaatactactcaaccttaaagaagaaaatgctgccatttggaacaacataggtgaatctggaggacattatgttaagtgatagaagccaggcacagaaagtcaaataaaacatgatcttacttatatatggaatcttaaaaagtagaatttatagaagcagaaagtagaatggtagttacacggggatgactgttggggagatgttggccaaaggaaacaaagtctcaagaggaatgagttaaagagatatattatacaatatggtgactgtagttaataacaatatattctattcttaaaaattgctaagagattagattttaagtgttctcactacagaaaataataagtatgtgaggtaatgcatatgataattagctcaatttagccattccagtgtgtacatatttcagaacatcatcttgtacatcataaatgtatacagttttatttgtcaatgaaaagttaactaattaaaattaaaaaaactggtattatttgcctttattagaaatccagtaattactgggagacaaggaaacataatcgagttgaagactcaatcaatttgtactgatgaattggccaagggacatttctgctaatttgcccatttcttgggtttgtagaaaagcagggtacagacgatcgcttcagtggagaaagaagctctctaaatgaagatagcaagtggtgaagcagagtgattctgacatctgctaactagataagtacaccgactccaccagctcattgctgtgctttcattctaccctgtggaatcccttttagccaatccttgatcaaataatgaacctattgcagaaataaaggggaagcacgtccatcactacctccctaactcagaaaaatcaagcttttttctgttctacactgtttcctgtcatgcgtaatatagcaaattaattagtggatctggcggcatttgctaatacaattcctctcccttgcttgaggtgaattatgttcatgcttcagtcacttgaatattactcttccatgtttgacggaattttgttatcaggtgactatattgcacactatctgattctaattaaaccagaaaatagtgacattgtacaagaggagaatgtttcacagtgtgcaccacccacccccttgtcgctacatcccagtttttagagctttttgagctgtgcttgggctattttcttatgtttacatcgtcttacgcttctccagacacaatggcttcttgggcattgccttcatctactaggtaatttgtataaattgagtcctggaagacataatgtttacacttgtctttttttttaatcagaagcataatgcacagtagcaaactgtgagtatttcagatgatatgaaagaagaaaatgtgctgttttgccaaaatcattcatgtaacttggaaagaaaagtttctgagagaagaaaaactaacattttagaggggaaacggagaaatgggctataaagatgaattggggaagcaatgtaatgtagaggttaagatcacaggcttgtagtgcagggcttgacttctggttctgtctttatctgacactatttctttctccttacacaataataagtgctcaggagttgatttgccgaaggtctaatgatgaggtagtaaaagaaccagggctggggctcccattccagttttcctttttttctataccctgttaaatgccaagccctgattctgccagggtggagagtgaaggggagtctctggagtcatcaattacagcaggtcactgggtatcagagtctcttttctcatgaggataaagatgtccttttgagttagactatattcacccttcatgaaccttggggacattgatggcagggagagttttctaaagctttagacaactcagaggtgaaataggcaccatgctgcaaatgaaaggcacttttatggttgtctgaaaaaaatacagcacactgctttaaacttagaaagcccaagtgcaagctacagtcaggtgtggtctgcaggctttggtcttttgtccctgttcaacagctggtaaagctgggagaggtaatcgctgatggagacttgctcctgttgggataatatttctcagaccatagtcctgccattttccagactttttcttttggagaaatgggctcctaccttggaagagccaattatgtaattcaggttgaacctggctcttttttttcccactgatctctatcttccttggtgaagaccacttggcctccgcctccctgttagatattattcttggcctatgtaagcagtggaaagcctgaattttgcccaggctttgggcaagatgaaatgacaccttctgggttggtggaaggaaagggctatttctttgggctacttgaaggacccagaaagcaaaagaaaaatcatgtctttctttgcagaatttctgctgtggaaagaggcaaagtcaatcaagagacagagatccttgacacatatgtattgaatatctactatattgcaggtcatattctgggtgctggggagatatctgaacaaaacagacaaaaatccctgccatgaggaacaaggaataggtgtttaatatggtctgtagaaaaagtacgggaataaaagtcccaaacctggcctttttactagtttatagtctagtggggagaaatagacttaagaaacaacaaaaagaggaacgtatatagtatattggaaggtgataagtttaatgaagtaaattaagcaaaggaaatagatagcaaaagcagagaagaaatggaggaggtttctatttaaaacagggaggtcagagaaggctttctgcaacagaagaattttgagcaaagacttgaagaggcaagagagtgaaccatgtagatatctgtgggaagaacattacgggaagcaaactcagcaagtggagaattcccagtatgttttaggaagagcaacaaggccaagtgtggtgggactagagagagagagcgagtacgggagagtggtgagaaatgaggtcgtcttcaatgattgtagtttgcttaacttgtggctgctggctagacaggatgaagtagtttgagttgtttaagaaggacttactaggtatgtgggatcagactagtgctaggctagaccccaggacaggaaagatgactgcattcaaggaccaagtagttcagttcaagattgaatattggcctgtatggaaacttagaaaacagtgaggctcaggtgtgttatatatagatatctgaaagaagagagaaggttgtagaggactggattggatataaggctctggaggcagactgcctgggtatgaatcgtagctccattacttattactggtgtgatcttgggaaaaccacttcaccgtctgaggatcagtgtttacatctataaaatggagttcacaatggaaggtacattgcaggggtgtgtgaggatttaagacagcacatgtttagcaagtgccatgtacatagtaagccctcagtaaatatgagctgacattcttattattcattgaggtggttagagaaggattctgtaaagcttgaaaccatggagttagtgatgtgccatggactgaactcaagggaatttctactagactgcccttaacttctcttagatggtgcttggatagattgcatgtgactgaaatagttttttggtgctggaagcatcataaggagataggaccagcggattagaaataaaggggtgatggttgtgcctttaccaacagtgtgttgctatggagaagaaggccctcaaggaaaaagaggaaaatgtgatcaaatacatcagcatggggttgaacaagagcagtgaggacaatgttcatagttgactgactagagtagtgtcaataagaatggcaatttattgagcatttgcacatgtcatctcacgtagggcttaccgtagtcctataaggtgggtactcatattatctttgttttgccacagaggaagtgaaggcttacagaagtgaagtgatatgctaaaggtcacacagctagtaagaggcatatctgggactcagctcaagggagtttccattagactgcccttaacttctcttagatggtgcttatatggcttgcatgtgactgaagtagatttttggtgctaggggcatcataaagagagaggtctagcagattggaaacaaagggataatggttgtgcctttactaacagtgcattgagctatgctcatttatgttcttatgatctcttagaaacagagacttggttctttcctgtcttaagaaggaaaatctgactgcggggtatggccatcccctaaaatatcaaaaagacatctatttccattttcttcctcctaatacctaggagacaacaaagtggatttccagtggtacttcccacatgagtagaatgaactttccttggtaaaagttgactttcttactaaaggacaaaatatataggctcctcaatttgagccatgggatttggtgggcagctggactgagcccaaagacatccccacagggaggcaaaactggctggtatatgtggaaagagtgagtggctcagggaatagatgctgtgagccaggttgtgaatttccagagcccagggattagagccacttgacattcactttaggtgaactgtgttgtcttacatcctatttttcatgaatacttttaaaatttttatttttttcttttaatttttttgacacagagtctctttctgtcactcaggctggagtgtggtggtgctgtctccactcactacaacctctgcctcctgggctcaagggattcttgtgcctcagtctgctgagcatctgggactacaggcatgcaccaccatggccagctatttttttttttttttgtatttttagtacagactgggttttactgtgttggccaggctggtctcgaactcctggcctcaagtgatctgcccaccttggcctcccaaagtgctgagattacaggtgtgagccaccatgcccagtctttcgtgaatacttttgatgtatggagtaactcataaatttttaaaaaatatttcaaattcctaactcttcttgaaacaataggtattatgggtggctagtttatttcttttcagttaatgattgaattcattgagcccttactaggtggtgagcactgtccgaggtgctgaaggaagagacaaagataggattactgtatctcagaagcttatattttagagaacaacaaagtaccatgtacattttaccatgtaagtttagcctgttatatatgaaaatgactttttacctaaaagtaatgagcacaagtcatgggttttaaaggtaacttgttcaattctgacattatactcttggtcaacccaattggtgaatcagtatttccttcaatagtcctgggataatgaagagttggcaaacatgttacataaaaatttaggaattaagaatattggactcttcctgaagataggatattttaaatgcaggactagagctcctgaaccatatattatagggaaaatctagagaaaaaataaaaggtatttatcaatgtttggttgtgtgatcttgggtagcttcttgtgcctcattgtttttgtcatttagaaaatgatagaattaatctgtacattgataatgaagtccctttaggttctagaattctgtaattttggtcttgaactgaaattaccatgacaagggattttgatagatgttgcctaattgctaaccaatgaaatgttttctacaactccacccctgctcttttggcattttatctttgttaagtgaaaaatgatatgtgttgctttgaactttattgctttaatttgttgcagaagttgagtggcttttcatatatattaaatttgattggttactttatttaaaaaattgtaaattgtatgattttggtatccaggtaagatactgtgaaagttaccttgtaattaagttcttgggtgatttattggaggccttaatattattataatagataatagggctgtctaaatgccactgtacttggttatcaagctcaatgccatttaaatttttttcaaaaaattttcaatgacattcttgttattgttaacagtttacttttttcccgtgattgaaaagactaacactcaagtttgaaagagaaatgttaattttcagggctgctgcaaaccttgaatttgaatcctaatcttgccacttactgcttgtgtgaccttcagcaaagtgctcaatttatagaacctcagtttaatcatctgtatattgggaataatagcaaaatctgcctcagagattattgataggattagctgaaataatgcatgcaaaatgcttagtttattgcctgaaaacttattaagtataataaatatttattattgtaatcaacagttgtactagagagctattgcacaataattatgattataatgaaaatgataattaataagacccccacagtttctgatttagaatgtgtctggggaagagcctgaggatgtgtctttctaacacattttggggtgatgctgatgctggtggtccaggcaccatgcttggagaactactgttctaagcatctgaacaatgtgatctcatttggtccttaccagatcactctaggaggcaggttcttttatgatggtgctttaataagtgagggattagggaggtttagtagctttcccaaagccccgcagcttggaagtggtggaaccaagagttaaagatttatgctcttctttccacctgtgattatttatgtggagttctaaaccattgatctcctgtatccacccccttgatgtcttctctcaccacctttcccgactctaagccattgccaattactatcaccatccccttgtccacactcgtgattcctgtgtccctctcttgcgttgtttgcttggcatggtcacaatcccggttaaattcatctctctgcctactctgtacctgcccttgagaaactgaacacggctggagaaacatacaaaactactccgaccttgccaggaacctcgaatgacccgttaacactgccaggagatcacactgcactttcctagcccattcattctgcatcttgctttttcgtttctttaaaaatttattttattgtggtgagaatgtttaacccaagatctaccctcttaggaactgtctaggtgtacaatacagcattgttaatgattggcacaaagttcagcagatctctagaacgtatttgtcctgcatgattgagactttattggttagcagcttcctctttcccccttcctccagcccctggcaactaccattctacttaatgtctctatgcatttgactactctaatttcctgccataaacaatatgatatatctgcacctacactcatgcaatatttgtctttttgtgactggcttatttcactaagcaaaatatccttatgattcatccatattggatattgcagaatttccttgtttttatttatttatttattttttgagatggagtctcactctgtcgcccaggctggagtgcagtggcgcgatctcagctcactgcaacctccgcctcccgggttcacgccattctcctgcctcagcctcctgagtagctgggactacaggtgcccaccactatgcccagctaattttttttttttgagacggagtctcgctctgtcgcccaggctggagtgcagtggcgcgatctcggctcactgcaagctccgcctcccgggttcacgccattctcctgcctcagcctcccgagtagctgggactacaggcgccagctaccacgcccggctaattttttgtatttttagtagagacggggtttcaccgtgttagccaggatggtctcgatctcctgacctcgtgatccgcccgcctcggcctcccaaagttaattttttatatttttagtagagatggggtttcactgtgctagccaggatggtctcgatctcctgaccttgtgatccatccacctcggcctcccaaagtgcggggattacaagcttgagccactgcacctggccatttgtttttaagtgtatgtatataccacattttctttatccattcatacatcaggggacatttaggttgtctccacatcttggctattgcgagtagggctgcagtatacattggagtgttaatatctctttgagatcctgatttcaattcttttggataaatactcaatagtgggattactggattgtatggtagctcaaattttttgagggagaaggaatctccataatgttttctatagcatctctcactttcttcaacacctattttacatgtctcttttcttctcaaaccccatctccttcccattcttactctcagctgatgaccatgtttctttgctctttcagagaaataaaggaaccagaagggaattcacactgactcccataatctcatctccccacattctggcatctgtactcacccactccaacctctcacctgtgcccataggtggaaggagggaaggaggttcacagtgagtgtctggagagctggcgatgttctgtttcttgagttgggttctggtagtataagaatatccagattacaattccttgagctgagtacttataattcatgcacttttctgtgtgcatgttatttgtcaataagtccaaaggcaaaaaaaaaaaacagataaactcattaaagtttaggatgaaacagggataagacttatttgcctttgaaatactagttctcaaccaaaggagatcctcatccctgtccctccccaccaagggggcatgtggcaatttctggagacatttttggttgtcgcaactagggagaaggtactcctggcatctagtttgtagaggtcagtgatgctgctaaacatcctacagtgcacagaatagtccctacaataaagaattatgcagccccaaatgccaatagtactgagattgagaaacttggccgcaaaagaacctgtctgagaaactccaggatcacttgaacattaatttcatccaccatagtctttgctgatattgagctccttatttactagattcagagaatgtatcctttcccaggggagcatctgagagcaggagcgaatttcatttgctacctcgtaaatctctgaaatggaaaacaggtctgaatattcctctgtctctctctctcccctagtctttgaagccctccaaagtgggccatggcagttagctcacaacaaattccccagacacaatttaaatgtcattttgggggctgggactagggcatgaatatttaagatgtaaattgtttgggctgtgcctaaatcttttatgggttttactggatgagaaaaatgagttactactttttgatgaagttcactttcctttcatattattagcaaacccagccaagtgaaccagactgcatctgccagagaaaatagggatgcttgtttgcgggatgatattagattatgttcccagcatgccgtatttatggttcaaaaatcaaagaacaggtaggagagttgtcttaggtcagcgtgtccttgccagtgaaagtagcttaccaaatacacttgggaggacagtttggaggagtggtggagagtagaagtgaatttaaatagtcgaactctacctgaagagttaggtaccctgagggttgattttagagaaatattgaaatcacgagatactaactccagagattagtcctttcttattcttcagtttaaatcccaggggatgggtacagagcagaggcaaaggaaaggacacacaacaaggaaaaacagagagagagagagagagagagagagagaaaaagagagattgattgatttaacaagttccatggacttcagaaagaatatatattttaatctttttggaagaaattatgcctcctacgtctcatttccaacccctacccagaaattaattttgaatgttaatatgaaagcaacctctctcttctctgaatgctgcttttgattctgacagggtatctaaaaggctgctattagacacattttcattaactaataagctggttcttgggcaaaacatgaattttttgtcatctcatgtgaaaattgtaaaaagctataattatgaagaaaatcactaattgtaaggcacaaaatttgtttgctaagaatagtcattaaggatcgacaaaagcattagtaacttcaatatcagaaaacaactattgaaatgcaagtggaatcaaggcatttgcccagacataataatggctttacgtttaaaggtctataattgtggtttgatctgagacattgttgggaattttcaagaaacaatacagagtagggctaaatacttaaagtaccgtggcttttggattccaaattacagactcgagttttaatttctagagaatattactgtagggagagttactcaatgatattgtcaatgctgttattgctttaggattgtgatgaagtggtcaaaaccaggacaaagaataatatttctgtggcccagacgttttatgatactggctttgcatgcaaagtacctggcagctggcagcaagtgaagtttgcacatcacttcatgatgtatgtcccttctaaagagtaacttttattgtttctgctttctgacaaatatcctctttgcagaaaattaggaaaatgcagaaaattgcaatgaagaaattttaagttctccttaattccatcaacaagagatagccagttaacattttggtgtattttcttctttttatttcgttttaaacttctgaagtataataatgtgataaagtacacaaaatttaagtatccaacttaaaatgaatttctatctatatctccatgtaaccaccacctagatgaagataacgaacatttccagtaaatttccttccttcatgctgttttctagtcagtactcacctctctgcctccctcgtagtacaaggtactattattctggttcttctcacaatagatttgatgatttttaaacttaatataaatggactcctacagaatatcctctgtaggtctggcttctctcactcaatattatatttgcaagattcacctagcttgcttcatatagctatagtctttttcattgatgtatagtatttcattatcttttatactattacttatccattgatgactgttgagttgttttcagtttttagctattatgaataaaaaacaaacattcttaaaaatgtcttttgtggattttcagtaatttcttttggattcctgtactttttcgtatgtgtgcatgtaaatgtgaattatacagaaggttgaatttacattatgtctctccatctccatctctatccctatctgcatctcaatctctatattcttattaatcacagtaattaaatgtcttctaggaaaccagtctgtcttgggatccctgccgtgcttggacattgactgggggcgatcttggggaaacaacatggtcctgcacatgctacataactatttacattctttagatgtatagactcttttctcttttaccaggccagcatgtctccagctgggttttcctgggatttagccatggttatcggcctggtatccaggagagaagttaagggaggcttttgaaggggttagctgttgccttgccaggtagaggcttctaaagcatctttcagcacagtggagctcctactagggaagagccagctacctgtacaaacccagagagtatggaggcagagcaggcagggcagtgttgcagaatctgtattctcagcagcatccatccagctgtctctgtctcatattttaaaatctcaagtttttcccactagaaccctgacctttaaataacaggcctaccttggttgagcactcaaacatctctgaagtgctgcaactataacaatcaggtcatcagtctgcctttcagctcactctgcccttccattagagaacacagtttgtttttttttctttttctttctttcttttttttttttttttttttgctagctaccacagaggctctctgggcctcgctttaccattaattgtttgataatagccttcagtctgtcagtatttttctgcagggcatcaataccactaggtagtaaccagccaactctcctgactttgaagcatggttggctccatattttccaattgcttatatcactacatttgatacagcatttcctcccactgggatattcttctatgtcccagcaaaatttttagcaaccgagccaccacctttggtcaaggactaaccatgttccatctaccagtcaggacaccatcttcacctgctgggcagtgggtgagccagtcttaaattcccatgttaccgcttgttttcttgcaccactgctggcctcgcttgtattagtcccagtcctctgagaagcagacagcaagacaaggtcaaatatgcatggatttcattatggaaaatgcctttgaaagaaaatggtgagggagctagagaaggttggaggagacatcagaccacagtgcaagtctgacccccaagtgaaggagagagggacaaatgttgggtggaagtgtcctagactgtcatgctgtgtaaggaaggttcacaagaccaccagggagttcttgaaccaaacttggctgttagaggagtctctcacttcccaggaaaggggcttgtcttggtattcctgctgttctcagacgttagttggatgcagtccatgggaagcatggcctctgtgcaaatgcaataatagattttcaggaagctcttgggattttggtcaattatactctctgtagctggaagtctatgagacgcatttttctggtcatcacaaataggatcagcacaatacctgtaagtctccatgttagcgacagttatgatttccttacatacttctacatttagggtgttgctgatttgtagtttgataaataatgctgctttgagcattgacataattcattgtttccttaggacagatgtttggaattagaatggtggggcaagaggatgtgaacattaacattcttgatacaaggttgcaaattgccttcctgaaaggcaagaccaattcaccatgccccccattccttatggaatacaaagtgcttgctttccttactcatatgaggtgcttctgtgttccggatatataagaggtcatgctgtgcaatgcagaggacaggtggaattcatgacacaagctggtgggaaagggaagacagaatgattatgggtacaatgtggaatgatttctatatgagcttagtttgactgagatggttagtttgggagagagagggtcatggatgacgtggacatagcagagggaaagctccaccttataacctcctcatgccatccatatgttggagaggtcttgtgtgtttcctataagaggcttcctggccaaaatgtcacactgtgagttctatggggaagcctatgaataccttgcctactgctgtgtttctgccacttggcatatataataaaacagatgtcctgtatttacatttgagttttagagaaagagagagcgcaacggttttctaggagcatatcgtatgagtgtcagtgcggagtagtgggaagtgctctgtatttacctggggttgaattctggttctgcaggagacctgctgaacctctgagtctccatttcatcagactcagtgtaaaatgtagtagcagatggaagtagaggcatttatcttcccttcctgcttcccccttctcccttccccttcccccttctccttccccttccccttcccccttcctctcccccttccccttccccttccccttccccttcccctccctctcactctcagctgcctgttttctattcccccttcctaagaaacccaatctgccttttgggggaattatctctccctaaaatgcagtcttagtggattaataatccatggttcctatcaaccttctggactagaccagggacaggcatgcgatctaggatatggaattttgcatagaaggatacagttacaagattccatggctgatgattcaatccagttgttgagggatgggggagaacttaggtgataataatgaacaatttcttctaccaggagcatctgtctgtttaaatcctagttcttcagtctccccactaatgagctccttttaataaattccttttctgttttagtcagttgctgttgattgcaaccaaagacccctaactgataaacatttatgctcaaggtttttgactttgtgctttttttttttttttttttttttttttttttttaaaaagaattcaatgaaaatgtctactagcttaatcagagtctaaaaaaactgggattggcaacggggagaatcttgatttccagttttcatctttttcttccattttacaacttctgccttcgtatcttttctagcaactgtcctgttcctccaaccgcaatttttaacttccaaaatgcttcataagcatggtgaaattatccatacttatatgctgtgctgtagaattcctttggagaacacacaatatgaattgaaaggagctgggaattaacttatcatctgttttgaagagatgtgtgggatgtggggcggagttttttgattgtggcttgaaaattgattctaattgctgtttttattgctggtttagctgatgctactttcagttatttacattttctgtctttttttatttttattttttagacagggtctcgcagtgttgccccagctggaatgcagtggtgtgatcacagctcactgcagccttgacctcctgggctcaagagatcctcccacctcagcctcctgagtaactgggactacaggtgcgtgccaccacacccggctaatttttgcattttttatagagacggggacctactgagttgcccagactggtttcaaactgttgggctcaagcgattagcctgccttatcctcccaaagtgctgggattaaaggtgtgagctaccacaactggctctatgtctttttaaaatgacttaggcaatggcatatttgactccaccccaaatatatttattcaaacattgaaaatatatctacatactcatgtggctgggcaatttagaagacaactcaaacccaacaattccagatatacttaaaatactgagactaaagtatcctctgatgagggtagtgcttgaatatctgaataattatcttaaatactgaacaattcagttacctctgagtacaaagatacatctatagtacagtggtttagggaattgactttggatttagatagaccttggtttaaaccctagctctgcttgttatagactgcattgtagggaaattagttttctcaacagtaaagggaataacaatgctattagcctaggcttatcctacttcattcttcagacctttattctgggatgctttccttaatatgtcaccctcaacctcagcccaggttggactcttgttatgcatgctcacaggactgtgtttattctcccagagacccggttacagcttgcatgggtacacttttttattagattatttgattacgtcttccccagctccctgtatcacactgcgctgtaagcaccgtgaggttagggacaaccatatctatctccttccccatttattctcagtgcctagctcctggttggcactcaataaatatttatggaatgactgaataaatggaaaaattctttcccataggggattcactgagacaatgaatataaagtacagtggctggtacatagtaacaactgagtaaatgtagtctcccccaaagaaaaactgcaaaaaaaaaaaaaaaaaatccaaacaacaaaatcccaaacaccctcaacaatcaaaccacatgtcatataagaaataaaatatttataggttgttgtcttcattaagatgctgacttttcagagtaagttatgctcttgaatcaaaccacagctgattttagtaatttaaaataagtttatttcttgctcatgtggcaatctgatgaaagtcaggttcatggtggccctatgactctcctaataagctaagtgggcctgaagggtctcccatcagcaattaagtgcttgaatttggaagtgatacaggtcatttctactcaaagcccattggtcagaattagtcatatgacctcttctagatacaagtcaggctagtctcctgtgtgtctaaaaggagaggggccaggcacagtatcttatgcctgtaatcccagtgctttgggaggccaaggtgggaaatcacttgagcccaggagttcaagaccagcctgagtgacaaagcaagaccctgtctctacaaaaaaaaaaaaaaaaaagaaaaaaaaaaaagaagctgggcacagtgacatgtacttgtagttccagctactctggaggttgaggtgggaggactgcttgagcccagaagtttgaggctgcaatgagctatgatcatatcatatccctgtattccagcctggatgacagagtaagacactgtctcaaaaaaaaaagaaaaaaaaagaaaaagaaaagaattggatatcagtcaacattagtaatgtctactgtaggctgttaaatgaagctaagcatacacttttctttaaaatgcagtgcctgggccagggtagaggttctataaatacttgttgatgaaatacaggcttgagtattctacatactaaatgctaacagacttaaacgaagtggctacgggtggaagtaatattcatggtcaaaatttacaatgctagactgtgccaggaggtctttctgcttggatggtttacgggctaaggtgaagggtctcagtgccaaactgaagaggccaaagagcataccaggggttggtcccttagagaaagaagacaaaggttctttcttctttcctcctgttccttggagatggatgagatgtgcttttggctggcatgttagtatcctagtaccacaaccttgggtaagccaaataaagttatttcttcacaattttggaggccagaagtccaaggtcaaggcgtcagcagggttggttccttctgagggccatgagggaaaggtctgttcccagcttccctctttgacttgtaggtggccgtcttcccccatgccctcacgtcatcatctctctgtttgtttgtgtccaaatttcctcttgttatcaagacaccagtcggccgggtgtggtggctcatgcctgtaatcccagcactttgggaggctgaggcaggtggatcacttgaggtcaggaatttgaggccacctggccaacacggtgaaaccctgtctctactaagaaacaaaaaacaacaacaacaaaaaaacaccaggtatagtgctgtgtgcctataatcccagctacttgggaggctgaggcaggagaattgctcgagcctgggatgcagaggttgcagtgagctgagattgtgacactgaactccagcctgggcaacagggcaagactctgtctcaaaaacaacaacaacaacaacaaaaacaaacaaaaaaacactagtcatatcagattagggcccatcctaatgacatcataaaaataaccctgtaaagagcctatctctaaatatggttacattctgaggtactaaggattaagaattcaacatatgaatcttttgagggttagacacaagtcattccataacaactagtcaaattccaggatgttgcattgacctatagtgtttagggtcacagtctgcttctcttctggggtctcatctcttcagaattgttctcttgcttttgagtaaaataggcataataatagtatctacttcaaggtttgatatgaagattaaaagagttactacatttgaagtacttaaaatagcacctggcacagagcaagtacccactaagtattagcattactggaagtacttgttgtcattactttttcaaatcatgatcacttctattaggctggacaatctttctttatttgtctcctaataatattagctgctgcttactcagtacttgctgtgtgcccagcactgtgctaaaggctttatatgtatcacttcatttaatatgacagcaatgctaagagatcaaatctgttgttatcctgaaggtatagagtggtagaaacagggatgatactaaaaaaaaaaattttttttagaccaggcatggtgggtcatgcctgtagtaatcccagcactttgggaggctgaggcaggtggatctcttgaggcaaggagttcgagaccagtctggccaacgtggtgaaaccccatctctacaaaaatacaaaaattcgatggacatggtggtgcatgcctgtgattccagctacttgggaggctgaggcaggagaattgcttgaacccaggaggtggaggttgcagtgagccgagattgcaccactgcactccagtctgggtaacagagtgaaactcggtcttattttattttatttttttaacaaactgagaagcaatggcaatgaaaggtctaggacacccttggccctgccagatattaagagttagttcctaatccgtagggattagaaggagggcccagagtgatgggagtgactctgggagttcagggaaataactctaaccagtagaattatttcaacatgttaatagctgacgagactgtacagaggcatcctggttcattgtctgccctggagggacctgggggtgactgtcccagatccatgttcttaaatatttgctagcgataaggctagagagcctcattttacagacaagagattgagaaccagagaaggcaagagactttcatgaggtcacgcagcgagcaggttggtgaagtagcctgactcctgattcctaggtctctgtgtaaattaagttcctttttcctgcacctctcactgctagtcaagaagcagcagcccagctcatggagaacggcaaactgggatcccagtaggatcccaatgctgcagggctctgtctccctcttttgctcacctggctggggtgggtagactgagggcttggccacctctcaaactcttatgctgtctattctgacaatgatggcagagggaagtggccactgtctgggacagactggcctgggggttgagcccactcagcaggcagatcttcaggtgccttttccctcactgagcactccagcaggcccagatgccaggtagctgagtcggccctggatgtggtgaaagactcagaggcacatggggatgtaccagaccagagcactcacctgtcctctttcctgacctgaaagagagacacacagaggcaaatgagagaaagaccaagaggtaaagccaaagagacaaagagctacatagagaactgagcaacagagccagaggcagaaagacccagagatgcagagttaagacagatagtcagatggagctcaagagagatgaagaaggaacaacagaaaaacaccagcgaggatgacagggaaaagcaaagaaaggcagagtgaaagaaacaggaacagtaagagagggaggggtgttggcggggtgctgtggctcacacctgtaatcccagcactttgggaggatgagacgggtggatcacgaggtcaggagttcgagatcagcctggccaacatagggaaaccccatctctattaaaaatacaaaaattagctgggcatggtggcagatgcctgtagtctcagctactcgggaggctgaggcaggagaatcgcttgaacccaggaggcggaggttgtggtgagccgagatcacgccactgcactccagcctgggcaacagagtgagactctgtctcaaaaaaaaaaaaaaaaaagatggaggggtggagggagagaaagagaggaagagagagaggaggaggggagagagggggtagagggggagaaagagagggaggaagagaagcagagagagggggagagaggggtagagagacggagagggagaggaggaggatagaggaagagaaggagagaaagaagagagagagatgaagagagaagcaagagaagataaagggagagggaggaggtagagaagaggggagaggaagaggggagagagaaagaggaaaggagagacagaatgactgatacaggggtataggggtacaggagaggctggcaggtgatgtagccagtgatatggggagtagaaccgcaaagggcttgtgaagaagaaagaaaaattaggagaaaggccattggggcaggtggaagggaggaggactaggacacagagaagacttttcgtggcattcgtggctctgtttgttatgacaggggcagaaatacagactcagacacccacggcggcccattagtccccactgccccgccgctctgccagacggccgccccttctaggtctgttgcctctgagccttatttattgctccaaaatctgggaccatggggagtccctgctgggaagctcaggcggaagcttccatctaaatcctggactcggcttccagccactgcagctgaacaggagggacagtgggaggacagagcttgatttgtaccatggctttttcacacatggagggtggtgtcttttttctggaagcggtaagaagattctgtgctgtccctagggatgtaagtcttgaccttattcctttccactaaagaaacaatttaaaaatccaaagccaatttcctaataccactctgggcattttaaccagagttgaagctactgaaaatacagtagctaccatgctaggaatgttgtaaggatgatctcatttatccctgtataatgctatgaggaaggttctattatcttccacttttgcaggtgatctaacaggctcagggaggtgaagaaacttgcccaggattctgtttctgtatataccagagtctgacctgtctggctgtgtttcttagtcactgtgccatcctgcccccgcctcccaccaccattatacagatgaagacatcggggcttgtcaattttttttaatacaataattttattattttttaaaattagatatggagtcttactgtgtttgccaggttggtcttgagctcttggcctcacgcaatcctcccgcctcagcctcccaaagggctatgtttacaggtgtgagctaccatacctggctggttctttttgtttgtcttttaacttttatgtttaagtttgggagtacaagtgcaggtttgttacataggtgaacttgtgtcatgggtgtttcttgtactggttattcaccacccaggtattatgtctggtacccattagctatttttcctgatcctctccctcctcccattcctcatcctccccctcctcccattcctcatcctccaaaaggccccagtgtgtgtgatttccctctatgtgttatgtgttctcataattgagctgccatttgataagtaagaatatgcaggatttggctttctgttcctgtgttagtttgctaaggataatggcctccagctgcatctgtgtccctgcaaaggacatgataccgttcctttttatggctgcatagtattccatggtgtatgggtaccacattttctttatccagtctgtcattgatgggcacttaggtcaattccatgtctttgctattgtgaatagtgaggcttgtcagttctaatcatttgcccaaagtcacgtgggtagaaaggtgcagaatgaggatttaaacccagtagggaattagacctcagtaggtctgcttaatttcagtgcgtctgctcttatcccctatgcattggcttggggattttcagaaataggtactccctccaggtgcttcaggcaccggtttgttgtgcctcatgaagtaaagagagcaaaagctccaacagaactacacacttaaaaattgttgcagtagtgaattttatgttacaggtatcttaccataattggaggttaaaaaaattgtgtgtgtgggtctgctgaggtttgaaaaatttttgtaaacctccaattgtcgctgtctgtggagtatggttaatccattctcatctagtcgtcatgctattttcatgatgcagctttgcctacttgctgcactgacctccctttacctccagatcttcgttcctgcagattcacagcttctgtttccttgggtcttctgttgtattgtggccttctgtttcctgctttctctgagtgcctcactacttccaacattctctctctctctctctctcttagatggtgcaaaattaatcgcggtttctgccattaaaagtaatggcagaaaccgcgattaattttgcaccaacctaatggcagaaaccgcgattaattttgcaccaaccgaatatcttcatcaagtcaaccgtcctaggagaaaagatcagattgaatggcatcttaggttgggtttcctggaaacaggctctcaggtgtagatttgcctgcagggacttttttgagggagagcttttgggatcagcattatgggtggagtgcagacaatggtactgggaggcagagatgttggactttgacgcagtctcaacagaggcctcagccaataccatggggatgctttggagctggaattgtgttcagatttatccccttcaagcaagaggttcaggtcttaatatttctgacactggtctgttattagatatgagctgcccttagtggggggtatgactgcaggtgaggtggctttctttcactgagggtgattttcagagatggactgagctgacatctgttggctaccagtactcccaccagctaggggaatgtgagcctcagtcctgaggggaggtctgggtggtaccccacaacatcctctgctgatggaataatcccttttcagaatacagcagcccatgggaccacctccatggctcttggtcttccctgctccatccaatggatgtctgtatttgcctctgttgctaattcctggtgcaatcagatgcaacactggtttcaggtcctatgacatggaacatggaaaccatgtgcaggaatggcctggggctttgctcagatggggtggcagcacagcagagcctttgagcaccctggattcttgaccatagccatgatgccttgccagcttcccggagtccagaagagaattcctgtactccaaatttttcttacttaaggcctgctagcccagttgttaggagcacagatctgaaaatgttctgaagctgatctccaaatagcagaaccatttcttctctgctctacaaggaattcctcttgttatgtcacccgatctcaaagtattagacaccaaggaagtgtcccaagagtgtaggtggatcaatacatagtcacagcccctcctgaacaagagcaatccttctgctgttggccagactgccattcatgcttctcaaaccctctgaagtttccttgtgaacagttagttttttttctgcttagtctaggactttctttcctctctagcaattttcctccatgaagtgaaaacagacatggagacacatatgctacgggggctcaatatagcaccgtcagtcaaaccctgctctctccctgctgcagcaaggatatggctgggctcccatcctttccttccccttaattgatttccaaattcagcctcctaggatggtgccttggctggcattccaagttcagcctctcaaccttaatttaatgcttctagggtggtgagaacttatgtttcccacctactagttggcatctggctgattttcttatcctgaagaatttagtttcattaatgtcaaacctttgtacattgcatttgggctgtcaacagtgatgcatactcctgctgttcccagtcctcctgaaacagagtccttcacctactccaggacagtgttggcattcagggacccagttgtggcccatagcaagactgtcagccataggacttgcttcattcaacccaggagtcccagggcccgggctgggatagctggaggatgctaaaagcaggttggataattcagggtctgcttaattttgcccaggcagcctgatatgaggtcttgaagtcaagttttccagccttcttcttccaagattgtgccagaaattctatacttggagcaagttaacttttcagcactgagatggcaaatgtttatgattggattttcacactcctttctggacagaggacaatttttgttgtaaaatagaaacatagggataggaggacccaaggcaccttagtagggctggatcttggaagaatagtgatatgatgaaacaggttttgtcttctgtattttcttacccctattctttgtaacaaatattgattatttattgggagtaacccaaatccctttaggtatgccaaatatcccagatctcaccagcttcttggtataaatggggtcattttgagacaaatgtttagaccatacaggctcatagcttttgcctcttcctggtggaccccagtgttttcaggagtcctgcagagatgtctcacgtgtgctagaatatgtgctaactcttaggtttttttcactcaagacttttttgtttgtttgtttttgaaatgtgtctcctgcaaaccacttaaggatgacaactctctgctgtacttctgctgcagtcttccacaacatccctgattccctgccactctgatgggcgcatgggctcttttacaaatgtgccgtggtccgtgcattgtgctgctgttgtgcccctctgctgcaacggcaaggaagtccctttgccttgcgtacatggaacttgggtgccaggctcccaaagcagttcttcttgtgcccagaacctctcagccaagtgccagtttctcttctcccgtgaagactcaagccaacatagaccagtatagcttctcatgtctcaaagctcatgagaaatttacaaaaaggatcagtggacctctggatttttctgccttgtgctcaaagctcagaaggccctgcgttacatttaggaaggggaggcacaaggagaggatgtgccatgaagccactgctgaaaagcagacttagtggttcacactcaggcatgtccatcagtcaagctctccaagctgtgttttttagtgtgttgcataagccacacgtggtgtggagggaatggtgttagtttatgccaaatcaacagcagcaaaaataatgacatcatggacaataataaaatagtcaaccagcaacagatggaagggaagaattccagttatgctaagaaactgttagtgacacaaactgtttggagtcttagctggtcaaaccaaacccaattccactagccaaaaaataacaaaaatattatcattcagccagaaacatgagccactcaaatcccctgtccagaaaaacagtccttttgggatctgatggggcggaggggcaaagcaatttcaaagtatcaccctctgctcaccatcaaagagccttgtttgttcactgatgcccagtaaatcagaaccagggaatcagatacaaatttcctttgccttttgatttcctttattaatggaacctttttagaggtctgtttatacttttcacttgtacaaaatcacaatacttcacacaaaggcagcagatgataccgaaagctggagattgggcctaattgcctctctcgtaaccagtgctaacagagccttctcttggatgtaaggaaacttgaatctaattgcagggttggttgttccaattctgtgtaactataggtttctttgtctggggttttttcctcctcaaatttaatgtttctccttgagctcctgtcagatagctcctttaggaatctgagtagagtaaccgttgattattttaaactgagactgaattttaagattacaatgttccaggagtggcgtctctaagacttgaagtgcctctgtgtccacatatccccctggatcctcctgttgaggtttcatgtgaacctcatatttgtttcatatttggtgttatgtgagccttccacctggccataggtgattggacagggactggcacttgagctgaaagtagccaatgagttagcctcatgtaagagtccatctctacataggactatgattaattagacccattacgttctccttctgaaagttttgaatgagacgttgctcagagtgagtgggatatatgttcattctagtaggaatcttgtctgttttctttcctaatttatcaccattattgataatagtacccagcacttggctgggcatggtggcgcatgcctgtaatcccaggactttgggaggctgaggcaggcagatcacaaggtcaggagttcatgactagcctggcaacatggcgaaaccctgtctctactaaaaatacaaaaattagccaggcacggtggcacgtgcctataatcccagctacttgggaggctgaggcaggagaatcacttgaacctgggaggtggaggttgcagtgagccaagatcgcaccactgtactccagcctgggcaacagagcgagactctgtctcaaaaaaaaaaataataataataataataaagtagtacccagcatggcacacaataaatatttgataaataaatgcacgcacccttatgtagaaagatttttaaaaaatgaatcaacatctctctccccatattttacctttttctcctgccaccaggcagccaggttcttccttatctcctcttttaaattgttattattcttttaaacacactttattttttaaggcacctttaggtttgcagcagaactgagtggaagataatagagacttctcacatatcccctgctgcctcacatgcatagcctcccttattatcaacatccccacagaatggtacatttgttataattgataaatctacattgacacatcattatcatccaaagaccaagtttacattagggttcactcttgctgttgttcattcaatgggttttgacaaatgcttaatgacatgtatctaccattataacaacatacagagtagtttcactggcctaaaaatcctctgggatccaactgttcctctctccctccctcccctcaacctctggcaatccctgatcctttcactgtctccatcattttgatttttccagaatgtcatagagctggagtcatatagaacacagccttttcaggttggcttgttttgcttagtaatatgcatttaacattcctccatgctttttatgacttgatagctcatttctttttaatactgaataacattgaattctctggatgtacatagattatccattcacctactgaagggtgtcttggttgcttccaagttttggcaattatgaaggaagaggctataaacatctctgtgtgggtttttgtgtggatgttaagttttcaatccatttgagtaaatataccaaagagtgcaatttctggatcatattgtaagggtatgtgtagttttgtaagaaacctccaaagtgtcttccaaagtgcctgtaccattttgcattcctgttagcaatgaatgaaaattcctgttgctccgcatcctcaccagcatttggtgttttcagtgttttggattttggccattctaataggtgtgtagtgatgtgtcatgattgtctgaatttgcagcttcctaataacatatgatggtgagcatcttttcttatgcttatttgctatctgtatatctttgtgaggtgcctgttcaggtcttttgctcattttaaattgggttgtttgttgtcttatttttgagttttaaggattttttgcatattttagatgctagacctttatgagatatgtcttttgcaaatcttttctctcattctgtggcttatcttctcactcttgattctctctgcatttttctgactttttgcctgggcaaaaaagatgggcagtatggtacagtatttaagtgttcagattctggagccatctgcctgagtgtgagtcctgattttgccacttgttaagcaattgatcataccatctgattctcaattttctcatctgtgaaatggagagaatattactgccaccctatagagttgttatgagaagttagaatggtcccaacgtgtagttagtaagcactgtataaatggtagtcattatttttgggattatctcttttttgcgttgtttggactcagtcactaattggttcttgtcttctaccaatcctttctttactcacaccattgaaggcacactggcctctacccccacctcagggtgtctgtccttctgtttcctccttttgaagtgctttcctcccaatatacttgtgtcttgctctttcatctcgttgttcagtatttttagctgtcataaacagaagcagtctaaaggtgatggggtttcctatctttggtagaaatctctgtccattgatgctagctatctcagagggaagaggagctttgtaggagcagagagggaggaggagaggttccttgagactgagagggaaaggagtctgtatgttcagagagtgatggagactgagccttgctctctgggaatgttcctggaaggtggcaagatctcaagggaaagctgcccccaggaagactgggggacctgggtccgccaaggatctccaggccccaagcatgacctatacactgcagaaccacttggattgaagtcaccatgtagactgaagcagagtgtacactggtgacagccaagtggactgaggtttgggtagacactttctatttcctactgtgacatgaaactctatttactctgcatctgacagagtaactgaggctaaacttcatgcaagttcatagggatggtggctcaaagccagagggactttgactaatgcaatctgagtcatagcaccagaattatgttatcaaacaccagatgtttgcccaagatccagttgtttgctgcacagaaagccaatcatagagacaataagcattacaagggaagattttttaacatgggtgatgtcacccaggagacaggagagaaatcccaaatccatcaccccatctgactaaaatttggggtttatacagcagggaataaatgtaactacatgtgggaaaataggaactagggagggggtaaggaagagtcatagtcaacaggaactagtgtaggaaaatatgaattagggaggaattgatagcagttggttggttaggcaatcatgacagatgagtggtctggtgtctcattgcagtgacctggtaagtttcagtttcttgatactacctcatggtcagtttcctgagaaaggaactcagataaggtaaatggaagtttctcaagttttaagactgggtatgtcaatttctacatttatttaaagaaccataaatatcagttctatgggataattgggctggttttataaagaaagtgatatttctttcaccttgagtttggactttagaattatacacaaaataaatatttccaagttcatccttgctcactgtaatttgagagactctagttactggtaaggttaccatttagacacgttccagtcgttcttgtccctgtgtctttcccccctcaccctgccctttctaacctttcaggtattggaagtgagttcccttctgagaccacacttttgaattgctcatatacctgcttgtttactgtgacatccagttgtatgtgttgattacttcagcctccccgaccaaactataggatgaaccttgagcaagaaataaacttttgttttattttttttttaatctcacaagaatggctgaaatttgttgttttaaatgagtgacattaggtgtgtttgttgtcctaccctcaacaaccttatcctgagcgatacctacattaaatccttaaaaacactgtcgccaaactgttgaaaccaaaggaagtgttcaaaacattggaaatggcatatctttacagacaaaatattttgccttagcaaacatgtggagaaggaagtggatgttgctatatttagagcacaaagcaaatgtgttgttttggagtattcaggcagataaacatgttcaaaaacatgttcaaaatgttccacctattgcctggttagaaataccaatacagcataaaagttcacagtatttccttctacatgttgtatacacacacctatacaccgataccatatactgtagagctaagggctgtttggttgctagaaacagtaagtatttaattaaattcacagaagttagagatcaaactatggcaggatgaaggcaagacacacacctagctcttgtgactccgtatcatctcctgttcatttgagtctcgcatggttttgcaaaattataaagtgttttcagattctcttccttcatcacatttgatagaatgttcacagatttcgtgtatcaattccttgttgaattttcactgttttactatcatctgttttattccctcattctctttggttatatattttacccttctgaacagtttctcctaattatgatacaatttttagcttttgtatttttgttacctaatttcagaatctctaaaaaggatgaacttaggagttgagttggaagggaggtttgggctaaagggacatttccttacctaagaatgagaaaacatcagttgtccatatcaagggatgggagatttgctaatggagattatgggggaacaaactatttcccactccagaaccaaccttggcaccacaactgccataaacttcttttttttttttttttttttgagacaaggtcttgctctgctgctcagactggagtgcagtgggatgatcttggctcactgcaacttccacctccctcctcccaggttcaagggattctactgcctcagcctcctgagtagctgggattacaggtgtctgccagcacacccagctagtttttgtatttttaatagagatgggttttcaccatgtaggccaggctgtctcaaacacctgacctcaagtgatctgcccaccttggcttcccaaagtgctgggattacaggcctgagccattgtgctgggcccattgtgtggaatgtttattcttcttcttcttcttctttttttttttttttgagatagtttcgctttgttgtcaggctggtgtgcagtggcgtgatctcagcttactgcaacttctgcctcccgggttcaagcaattctcctgcctcagcctcccaagtagctgggactataggtgcactcgaccacacccagctaatttttgtatttttagtagagacagggtttcaccatgttggccaggatggtcttgatctcttgacctcgtgatctgcctgccttggcttcccaaagagcttggattacaggcgtgagccactgcgcccggccagaatgtttattctaaaggcaatgatttcctcaactttctactttgtcttcttttaaacaagactctcatacaatctcttttgaaatcactacaatcagggagaaaaattgtttgatgtctgaccagttaataatgagactctggacaaattgttcagctccttagatggacaataatcatatgacttcattgaattactatgaagattatataaaatcatatctgggaatggcttatggggtgagggcatatggggtgagaacccttacgtctgttctttccttgcagctaatggggaggtagtgtcactgaactaaagtaggtccctttgcctatgcaactgaaagccaaacaccaaagcaccagatttttgtagcaagaaaggtttattgccaggtggccaagcagagagacaaagtcatgctcaagtctgtctccctgtactggccttacagctgcagatttaggggagcgatgttaggggtggggttttagggctgggcagtgattggctgaaagggagggatgtttagaaagtcccttggacatgccatcgtctcttgacacttcttcatgagttgcatgtgcaaattcggagggagttggtatgaaacatgtgaaaattcgggctgtgacatcgaaagattactcattgggtgagcaagtttgttctgtgcaggctccagtcagccatattggttccaatctgtttcggtcagttttgtaagctaggggggactgtagcaaactgtatcttttttttttttttttttttttttgagacggagttttgctctgtcgcctgcccaggctggagtgcagtggcgccatcttggctcactgcaagctccacctcccgggttcaggccattctcctgcctcagcctcccgagtagctggaactacaggcgcctgccaccacgcctggctaattttttgtatttttagtagagacggggtttcaccgtgttagccaggatggtctcgatctgacttcctgatcctcctgccttggcctcccacagtactgggattacaggtgtgagccaccacgcccggccagcaaactgtatcttattcctgcaagataagctcaagatttctgttagtcaccggtttctttaaccctgtggggcatggtttcagcagcatgacctagtaggtgttcatgctctaaagtcacatagctgggttcaaatcctaaactctgcctcttgccagctttgtataaacaggatgtgggggtgcaaattacttcagttctcaaacctcacttgcagtgtctacaaaataaataaataaataaataaaatgaaatctgatacagtgtgaggattaaatgaaatattgagtctatagcacttggtattgtaagtgctatatactcaagaaatggcacgttttgttaacttcattagaaacaagtatctcttttcagtccagtcctgtgtcatcattgtcttcatcatcatcatcatcattgtcatctttgttttttagagatcggatctctttctctgtctcccaggctgaagtgcagtgctgtgatcataactcattgcagcctcgaactcctgggctcaagcgaatcctcctgcatcagcccttgagggttcaggactctcagcccttgaggtgctgggactgcagatgtgcaccttcatgcctagctaagtttttattttttagagatgaggtcttagttgtgcaggctggtcttgaaagtctgacctcaggcaatcctccagtctcctgaagagctgggattacgaagatgagccactgtacccagctttgtatcttctaatagaagctcgcaatccttgattggaaacccttggggacacatgttttaaaattcagaatgttatggaaattagaaaggtaatgtggagcataaactatacattccacaacatcccactttcagtggggtctgcagtagcacttcctggtcagctcattactgccgttaaatatgtggatgttcatgctaggtgggatgtgagataaataaaggacataaatagcctcatttcagttctggtcaagttttgttgccaaatgaatttgtgccaaccttaattttaaaaaatttggtttccagagcttttgggaattcagaaacccatgcagtcattaaaaattctcctgttctgtgtatttaagctatttctagtgcttgtttctgctttaagctgtgcttctcctacatctctgtgtttcagtcaacctttcaaagctttctttggactcagctctcctcctttgacttcctgtgttttacttacccctctcatctctgtctctattctttacccccttctggacttcttctccttcgggagttcacacactactggcatgaagactgttttcattttctttgttttttccctctgctacattgtctctagattctcatgcctctctctctcctcctctgtggatttcagagtcttgcttgtgcagtgagggctccctgcctctgttcttgtctaagtatcatctcccatttgatatacccttttatttctggtgaagatattttatttttcataaaaacatcattgtacaatgctctatagaggaagaaaatttcctttaatgtcccccaaatgctatgtggtttaacagtcatcttcctttaaaaaactgaatatgtaattgataataacaactgatttcttgtgaaatatagcatttatgttttaaaaatttatttgcctttattttaactaaaggcaagtccagtttaaacctgtactttttgcagttagccaaatcaaagctatcataattcaaagacaataaaataaagtgctaaatggtggtgctgattctttgtttctgccctttcattcattggtggtggcgcttggctcccaccctaacgaccttaccaccctctttctccttttaatttcttcatctcttccagatatacctctttgttcatgctttcttttacaatgccaatatcattatgataatttattgagctcttactgtgtactaagcactttacatggatcatttagtttcatcctttcagtactccatgaggcagggtaaggactctcttaatccttatatttcagatgagaaaattcaggctgagagataaagtgacttgctcaagattacacagctagtcagtagcagaaatggaattcaaacactattgcattaaatttttgcattaatccttgttgcattaaactgattccaaagcttatgatttcagtcactatgcctttatttcctccattgcagcagatactgccattcctgttattgaattcatcttctctttctcgatttttacagcgtcttaaatctgactcatctctgctgccctcttttcagcatgccattatcttaggtggtttgtccacatttacccatttccatggttgaattgttggtccttatcttttcccaatggcacattgagattattttataatcaccacatactcatggtggactataggaccaatcccaatttcaaatattcttgtcctcacaaaccactgaagcatcctggaaataagatgctggtcagcagaaagagcatctgcttcctctgttgctagacacctgcccattcaaagtcatgtcttggcagaaggcaccattcaaagtcatgtcttgacaaaatggcttcatgtcataaagccatggtatctgtgttacctttcgggtatccgtgaataattgaacctatgtttgttatattagttagacttgctgtgcagcagtaaaccaaattgccacatttctaatttaatgtaacaaagacatatgtctctttcacctcaaagtcagaggtggtttaggagtctccttggcttttctccttgaacagtgactcgactcagggatctgggatgtttccattgtgtaactccgtcttttttttttttttttttgagatagagtctcgctccattgcccaggctggagtgcagtggcgtgatctcggctcactgcaagctctgcctcttgggttcaagaaattctcctgcctcagcctcccaagtagctgggattacaggcgcccaccaccacgcccagctaggtgtttttttatttttttttatttttagtagagacagggttttgccatgttggccagcctggtcttgaacttctgacctcaggtgatccactcaccttggccttccagtgtgctgggattacaggtgtgacccaccacacccagcagcaactccatcatcttaaagttccttgcttccagccacctggataggagagtgggtgggacctattcacagacgcttacccacaaagaacagtcattatcatgactacaaagacatattcattgagatgatttgtccaaggtcttccaagttagtaagtggtagattcagaagtaactaccttgactcttttttccatgataagttttagtaactagggatattttatctgtgttaatccttcctggcttgatttatttaattcacaatgagttattggattttttttctttttttcttttctaataattctgccaaaagttccagggagggttcccttgggtaggcttgggccatatgtccatctatcctcaaaccaatcactctggccatgacaatatggcattctgtttggtcaggtcagtgttgtgcatctgattctagagaggaggaaatggattatggggcaccttcacctctaccatatgtggtgggaacagtggagagctgtctcccaaaataaagccaggatgctgttattaaaagaaaaagtagcagatgtcaggcagtcaaatcaagagaaggactatcaagttgaacaactgaatgaagaaggaaatataaaggagaattagtgactaaggaaattaatcaatgagaaaataaatgaacaaatgatgcttctttgatggcagatgagggaatcctcccaaatggggaaaagtgaattaaaggcaagctgatgccacactgaacataggttttgaatgttgcattgttttgtggtaggttcatcttggttaaggtgaatcttggagggtccagaaactttttggtacaaaaatgattatgtgttccctgtgcacctttgacttttctcaatctcactggagtgggagcagctttcagctgttgacctgctaccctctgtcttagtccaccttgtgttgctataatggaatatctgagattgggcaatttataaagaaaagatgattatttggcttatgatcctggtggctggaaagtctaaaattaggcatctgcatctggtgagggcttcagactgcttcaactcatggtggaaagtggagggggagtgggtgtatgcaaagagattacatggtgagagagagagcaagagagagaaaccaaggaggccaggctctttttaacaacccactctcagatgagctaatccattcctgagagagtaggagcttactcattcttgagagagacattaatctattcacaggagatccatccccgtgaacaaacacctcccattaggccccacttcctgatactgccccacgggggatcaaatttcaatgtgagttgagggagactaaccacatccaaaccacagcagccccacaaaagaaactccataaagggaaggtagtttcttcctccccatccccaagccttaacctctctcctacaatttctgtaggcctccccctcctccttggagaatgtgttcctatcagccgagctgaaaaacagccaggaggctcatctgcgttcgcctccgtaggcaaagtgacttctgcaacaccaagcctagagtgcgtttatctctccctgagtcaaagagattttgtctataggcctttctgctgtgttcctccagagagaggtaaactgcccttaagtaattgctgaagaaggcataaaccagggaaatttgatttgagcatgcaatttgaatcgggaaatgctcatataaataaccggagcagctgaatgcggcgcgtttgtgctttatagattttttttttttttttttttttttttaatctcagggtcttcagaatacaagttctgctgcagcagcttaaaccacctcaggtctttgcactttggccttgtcctagtttggtactgttaactgccaggctagagtctggctaagttgaagttgtcttatttatctgtatctttggaaagaaaaaaaaattgcttgaacacccaaacaacattatatcatagaacagcaacacagtctttaaaaaaacaaacacttttgaaccaagaaggagtttggagtcatttagttcaacttccccaatgatggaataaggaattcagagatggtaagtcactttctgggttaactaagattttggaagtatcataatcagcttttgctgcagcaaaaaacaattcctaaatccaagagctgtaggtttctagcttatattatatctgtgccaaaggtcacccatggctctcctgggctgggctgagctctctcctcttgtattctcaaggagcagccactcttggcggcatgctactctcatgatagatgacagaggctgaagagcacagaaccaaatttcaggagttcatttatagctactgattggatatggtgattgtcatatctgttcacattccatcagtcaaaacacgtcccttggctgccaagcccaatggcaatagggcagggatgggaagcatggctagagtggatagggtgcaagtcattgtgagcaagtgatacagtccaccactggagagtggagaaactcttgcagtgatgaacgtccaagaagaaatgtgaaaactgagaaagtctttgatgtttcctgaatccacttattcttttagtgttactgatgttaatgaataaccacattcacccagtgatgtaagcttaatatgtgggtgtcattccagatcctccctcatctctgcttgttacatccaataatcaaccaaactctttccttatcagtacttaccaaacatgcctcaaatttcccccttcttttcacacttcatttcccaggtattttgcctacaggctctttccctccaatccatgcactgcaccatggccagagccacttcctctcatcctatctaggccactttcttgggtaaagtccttccacacttataaggataaaatgccattcttctaatgtcgccttaaacattcagttcctgctactccctccccacctacagctggccctgggttcaatatttactcatctaagagcagccagtttgaatattaaccaggtcagtatggaagcaggacttgggacatgctccagtctctgctgggatttgctaagtaggtgagaactaaataagaattgattataagtctcagaaggatgggaggaggaaagccaagcttctataatcaattctttgtttatagaggaggtgatccttcattttctctgagggctcagcagaataatggacttcttttttcccaacactagggtccagaaaatattactcgtcacctcctacaatgtaagccccattgagtatcccaggattctgtgatgatttaactatgaatcacccactcccaggtattggagagttgactcttgctttgatttcactgagatttgggatcatcctggccgtctttcctccatcctctattaatgagtcactggactatgctggaattagctggatattccacattgtttatcagtggctgtgtgcttttgtggcatgttcaaccattctttgtggctataatgcattttatgctccaatccataagtcctttacccctcatcctgattttgatttactcctcttgttaatctagaaaactgctattcaatatcatgagcctggctcacagcatctcttcattgaaagctctctttctggagtttacacactactggcatgaagactgttttcattttctttggtttttccctctgctacattttctctaggttctcaagcctctctctctcctcctctttgggtttcagagtcttgcttctgcagtgagggctccctgcctctgttcttgtgtgagtatcatctcctatctgatatgtgtgtttctggtgaagctattttatttttcctaaaaacaccattgtacaatgttctttagaggaaggaagttggagttttttacattatcttttttaaaaaatttatttttatttttattttaagttctggggtatgtgtgcaggttgtgcaggtttgttacatagataaacatgtgccatggtggtttgttgcacctatcaatccatcacctaggtattaagcccagcatgcattagctctttttcctaatgctctccctccccccaccccacccccccaacaggccccagtgtgtgttgttaccctccctgtgtccatgtgttctcattgttcagctcccacttataagtgagaacatgcagtgtttggttttctgttcctgagttagcttgctgaggataaagccttccagttccatccatatccctgcaaaggacatgatctcattcttttttatggctgcatagtattccatggtgtatatgtaccacgttttcttgatccagtctatcattgacgggcatttgggttgattccatgtctttgctactgtgaatagtgctgcaatgaacatacgtgcacatgtatctttttttacatttttttttttagctcctatgctgtcctgcacattatccccttcattcacttagttaattaatattggttgacagtttactatgtgccaggcaccatgcaaggcactgggaatgcaactgtgaacaagagtgacaaagcccctgccgtcatgataccaattgactaggggggattatggcatccaacaaactcacatgagtcaggcggttaccaatggggtgagtgctgtggaagaaataaataaggtgatgggctggagagtaactgggagaggtcacttggatcgtgaggtcaggaccacctctttgaagaagtgatgtttcaattgaggcctgaaagatgagaaagaactaggcttgggaatggatgagggaaagagtaagtgcaatgagaacaagggcacaggcttggaggcaagaaagtgcttgaggggcctaagtcttagccaacaatcaggagtgtggtctgagatgaggttataggagtgggtgtggatagaacatgtgaaaacttgtaggctattttagtaactctaggctgtatctaagaaaatgaaaatatattaaaggattttaagcagaggaatagcacaacatgatttaccatttcaaaagacaaccctagatgttgtgtgtattaaaatgggaagcagggatagacacaaaaagttcactttttttttttttttttttttttgtaaggaggcttttgcagtaacccagacaaaagcaggtgccttagactagggtaatggccatgtgcttacagaagagtggaagtcaagacctactttggtgataaaacaaacgggacttgttgatctatcgaagatgagttctagcagagataaatcaaggatgactttgaaagcaaggatggtttttgccatgagcaactgggcagatgcagaggccttttactgaaatatgaaaactggcagaggagcatgaggttggataaaatgagagctctttgaagacataacaaatctgagatgcccataagggggcgtgatgactaattttatatgtcaacttgacggggctaagtggtgccgagatagctggtaaaacattatttctgggtgtgtctgtgagagtgtttctggaagaggttactatttgagtcagtagactgagtaaagatgatcactctactgaatgtgggttggtatcattcagtccactgagaacctgaataaaaaccaaaggcagagaaagggtgagtttgttttctctgcttgagctgagacatccatcctctcctgcccttgagacatcagagttccaggttcttgagccttcagactcaaactgggatgcacatcattgttctcctggttctcaggactttggacttgcactggaattacaccccagctttcctgattctacagtttgaagatggtagattgtgggacttctcagactccataatgaggtaaaccaatgtctcatatctttctttttttaacttttattttaagctcaggaatacaagtgcgggtttgttacatcggtacatgtgtgtcatgggggtttgctatacaaatcatttcatcacccaggaatgaagcctagtatccattaattatttttcatgatcctctccctcctcccaccctccgccctccaaaaggccccagtgtgtgttgttcccttctatgtacctatgtgttctcattatttagctcccacttataagtgagagcatgcggtatttaattttctgttcctgagttagtttgctaagggtaatggcactcactgatcattagagaaatgcaaatcaaaactgcaatgagataccatctaaaccagtcagaatggctattattaaaaggtaagaaaataataaatgctggcaaggttgtggagaaaaaggaatggtctggcgcaatggctcatgcctgtaatcccagcactttgggaggccgaggtggtaggatcatgaggtcaggagatcgagaccatcctggctaacacagtgaaactccgtctctactaaaaatacaaaaaattagccaggcatggtggcgggagcctgtagtcccagctacttgggaggctgaggcaggagaatggcatgaacctgggaggcggagcttgcagtgagccaagatcacgccactgcactccagcctgggtgacagtgtgagactccatctcaaaaaaaaaaaaaaaaaaaaaaaaaaggaacacttatacactgttggtgggagcataaattagtctagccattgtggaagacagtatggtgattcctccaagacctaaagacagaaatactatttgacccaggaatcccattactgggtatgtacccaaaggaatataaaccattctattataaaaacacttccttaacctgcacaatgcacatgtaccctaaaacttaaagtataaaaaaaaaaaaacaaaaaaacacttccacacacgtgtttattgcagcactatttacaatagcaaagacatgaaatcaacctaaatgcccatcaatgatagactggataaagaaaatgtggtacatatataccatggaatactatgcagccataaaaaagaatgagatcatgtcctttgcagggacatggatggagctggaggccataataaatcttcctgtgtatctctatatatcctatttgttttgtttttctaaaaaaccctgactaatgcagaggctcaagccatctgtcttccactagactttgctgtatcactaatgttgagcacagtgcttgacatgtaacaggtactaagaaagtgttgaatgagagaattgaaatgagatgcttaaaagctacagatgactaatggcttctatgacaacggacaatcagagtccctagcaatggctaattaaaccattccaatctgatgtccaaaatattgtgtgctagagaccccctttcttttcccattaattgaacaggccctgtcttttttgctcttgtagtcaattgttcttcaagtgtaattagcccttgcattttgacagtaaatgagactccaatacttcgataaatggcttgtttctggaaaaggagtatttgtgaatagaaaactcagtcgtcttccccctttctcccacctcttcctcttccccctaatttgggtggcccttggcctatgttattaccttcagaaaggaacagtgtttcttcgaaaaggatagcaacacagaaagaatagttatcattcattgaacacctgttacatggcaggtgggtacattctatgcaatgcaacaatcctgaaaagtcattttaaaatatctttatgttccagccgagtaaactgaatgaagctcattgagactgaagaacttgttaaaattccacagttactaggaggctgaatcaagattcaaacacacccaagtttgtctgatgccaacatctgtcccttttctgtgattcggtgtctcccttagaccgtaaggagttggcccttgttgagaaactcctatggcctcacttgttagtggaaaaaatagcagtggctttgcctgttagcaaggaacaaacacccttccacttcgttcagatttcttaactcatgtgatctgttttggtcttctcattaaccctctgggggtggggggagtgagtgacaattatcacccgcattaggtaagaaaatggatggtgtctcacatagcttgcagtgggcgggtatgagcatcaaatctaggcagcctgaccaaccaagtcccctcctttagcctttacatgatgtgctctttttcagctgtctcgcccttcccaattgacgaagattctttgttcacattcgtgatcttatttggtgtgggaacacagagactgatttgctgaatttttttaagagctggaaacactatggaaggttgtctaaactaattcaaatgatttcccttgtcttgacccaagggggatgtgtgaatttctcaaaattgtccacatgacatcatgctcattaggatagtcaccatcaaaagaaaagaaaataacaagtgttggtgaggaggccaagaagttagaatcttcgtgtactataaatgggactgtaaaatggcataggcattatggaaaattgtatggaattttctcaaaaaaaatggaattacaatattatctcacaaccccacttttggatatacatgcaaaaaaaaaaaaataagcaggatctcaaagaaatcttagcactccagtgtacattacccaactatttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccattacccaactatttgtaatagccaagatgtgaagtcaaatgtccactgatggatgaatggatgcagaaaatgtggtctatacatacaatgaatatcactcagccttaaaaaagaaggaaatcttgctatatgctgcaacttgggtgaaactcaaggacactccactaagtgaaataagccagtcacaaaaggacaaatactctatgattctgatcaaagaagtatctcaagtagtcaaaatcataggaagtagaaagatggttggtaagggctgggggaaaggagaggggagggggaattagtgtttaatgggtatagagtttctgttttataagatgcaagtctgtggtgttcttttttgtttgttttttgagacggagtcttgctttgtaacccaagctggaatgcagtggaacaatctcacctcattgcaacctccacctcctgggttcaagggattctcctgcctcagcctcctgagtagctgggattacagatgtatgcccccaggcccgtctagtttttgtgattttagcagagatgaggttttgccatgttggccagactggtctcgaacttctgacctcaagtgatccgccggcctcccaaagtgctggggttacaggcatgagccactgtgcctggccagatgaaaaagttttatagatctgttgcatgacaaagcgacttacacttaacactactgaacggtacattaaaaaatggtggaagatggcaaatttaatgttatttgttttttactacaaagaattttgaaaacactgcggtggatttagcacttgaccccatgtcaccaggatccagtgaagtttgagctgcctaaaaatgaatgttgctttctttttttttttctttttggtccagggctatgcttctctcttaggttgtgtgttattttctttgccatagcaactttgagaagtaaatgggtgcttttgctacacctcagggggaatcaggtaagtgaggtaaacctaccagagagtccacctcttccaaggtgcattcattcatctcccttagaatggagatggagttatgaagtaaccaggggtggcattatcagtcctacatggggaaaccaagactcagcatgaccactggagtgttcagggtcacctgagggtattggtgatggagggtggggtgagacaatatcccaggaattccgatgctgggtccagagttagtgaagtgggaggagtggcacatttttaagacttggaactgaagaaaatgttgagaaacttggatgcttttcttatttttattattctatgtaaggaactttctacagcactaaagtgaatagttccattgagttgtccagccctgacccttgatctcaatgcccatcagtggcctcagacttgggctttctttcaggctttctttcatcctccaggctgtggggccctgtgagccttcttcttccccagcggtagatttttctttttaatgtttgaactccagaggcccccaagggcttctgccttaattaaaatttaaattcacaaatcatgtcttaaaccgtctcacaggcagccaaataatcgcaatcattagcaagtggttggagttgcttttgctttaatgcttttcaagggtgatggatacatgggcttagtcccatcattactgctgtcttctaccacccctctctccacaaaccttgctcagaaaacttttctataacacctttgttttctcttgtaatagagaagcctgtgttcttggttcagaatgtattaatgtgtcttggtctgtccctacccctgccttctgcagcttgcccatgtcctggaggccgtcctcatttggggaccagtcaattaccaggtaatggcttagagcacagacagagtgaagacccaacacaaggctggacgggcttccctaggagccacttctggactttggcattgggataggtcctttagtctggttatttgctcctgggaatttgcagagtgtcccacagctgtgcttcccctggtccagggtggctcaaccttggcactgccaacattttgggtttgacagtttgttgtagggagaatgtccggtgcattttagaatgtttggcagcctgcctgttctctacatactatatgtcagtagcagtccccagttgtgacaaacaagtgtcctgagacacggccaaatgtcccctggggcaaaatctcccagttgagaaaggctctagtccaacggcctctctaagaccaacacccttctctcagttcattttgtgttgcaggaatacctgaaactgggcaatttatgaagaaaagaggtttatttggctcttggttctgtaggcagcacaggaagcatggtgctggcatctgcttgtagtgagggctttagggagcttccagtcatggtggaagaagaaggggagcaggtgtgtcccatagtgagagaggaggaggtgccactctctttttaaacagccagctcttgtgtgaactaatagagtgagaactcattcattactgtggggagggtaccaagccatttgtgagggatcctgcccctccatgaccttgactttttatgacttacccttagaagtcacatagcactccttctgccaaactttataaattgaggcagtcataaatccacccatattcgaggggaggagacacagaccccaccttttgatggcaggagcatcaaagaatttgcagccatatttgaaaactgcacctcatttctattcccacgttcagagatgtgaatttttccaagcctttagcagataattcaatcccgccttgaaaaatttcaccaggtgtatttacaccaaaagcctacttcaattaatcaattctaatgctccaattactcagcttatattttcagacactctaataagcaccacaaatgaataggaactaagctgatggtgcatcaccctccactattaaaaagaccacacttgatttctcaagcagcctttacctttgtaaaatgaatttccttctctcacttgtatttagcacaggaaaatgtttccttagggttgtggtggagttgggacagatgggaagacatctaagaacatgtagcaattgtaataaaggtaaatttgttttttttcttgctttttttttttttttttggagacaggatctcattctgtcacccaggcaggagtgcagtggcatgatctcagctcacaaaggttacattttaaatgaagactgaagccttgttagtttgtgatttttgtcatgttgggaaggatgtggactcctattcagactctaggattaaacaacctgggcctcagtttactcatctgtagagtaaggggttggacttgatattttccaaaacctctaccaggtcctaaattgtctgtgattataggaatatttgccaagggcgattttctaacatcaatacccagagggagcacccatgtaataatcatattcattgacatgaatcatattcattgatatgaatcatattcattgaatagcttgccttcaagaaatactgtggcacttctggtaaccataccttttactctgcatttacttaaatatgtacatgcatttttacataagtggtagtatacattttcttttgtaatttccttttttcccctaccactataatacatgctgaaaagcttccatctcagtacctataattaagcttaattcttttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcataatattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagagatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgaggtgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggtaggcctggtggtgacaaaatctctcagcatttgcttgtctgtaaagtattttctttctccttcacttatgaagcttagtttggctggatatgaaattctgggttgaaaattcttttctttaagaatgttgaatattggcccccactctcttctggcttgtagggtttctgccgagagatctgctgttagtctgataggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgtcggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctagatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgcctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcatccatcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttcaagcttaattcttttccactgctacataatagtccactgcacggataacttaaaatccgctatagggattatttaagtgtagaccattttgatgtaaatttaagttactttatttcttttgcttttatattagcaatgcttcaatattagcaatgctgcaatgaatagcactgtgcatacgtcattgtgatggttaattttatttgttaactgggctaagggatgcctagatagctggtcaaacattgttttgcagtatatctgctaaaacatttccaaaagagattagtgtttgcatcagcagactgagtaaagaagatggccctcagcaatgtgggtgggcatggcgtaatccgctgaaggcccagatagaagaaaaaggcggaaaaagggtgagttctctgtcttgttgagctgctacattcatctcccacccttggagactggagctcctggttctcagggctacaggctctgggacttacaccagtggcctccccagttcttggtctttggacttggactgaatgacatcactggcttcctgggttcttcagcttgcagatggcagatcatgggacctctgggccaccacaatcatgtaagctaattcccataataaatctttgcctatatatactgtattgattctcttcctctggagaaccttgagcaatacagtcattttgctcctatgcagttatactgtagaataaatttctagaagggaatttgctgggtcaaaagttatgtgcttttataattctgatagctatcgacaaatttctcatcacagagatcataccaatttgttcctcaatcaataatgtataaaagagctttgtcctcctacacagggtatgatcaaactttacaattcttggcactctgataaggcagaaatggcctcattatggttttaagtggcatttctcctttgtgagtaagctagcatcttttcttatatagaagagtctttcgtatttctttctctcagaaaagtatccttatagactgtgaaagggcataacttaaaacatttttatttatttatttttaattattatactttaagttctagggtatatgtgcacaatgtgcaggtttgttacataggtaatacatgtgccatgttggtttgctgcacccattaattcgtcatttacattaggtatttctcctaatgctatccctcccccatccccccaccccatgacaggccccagtgtgtggtgttccccgccctgtgttcaagtgttctcattgttcaattcccacctatgagtgagaacatgcagtgtttggttttctgtccttgtgatagtttgctcagaatgatggtttccagcttcatccatgtccctacaaaggacatgaactcatccttttttatggctgcatagtattccatggtgtttatatgccacattttcttaatacagtctattattgatggacatttgggttggttccaagtctttgctattgtgaatagtgccgcaataaacatacgtgtgcatgtgtgtttatagtagcatgatttataatcctttaggtatatacccagtaatgggatggctgggtcaagtggtatttctagttctagatccttgaggaatcaccacactgtcttccacaatggttgaactagtttacactcccaacagtgtaaaagtattcctatttctccacatcctctccagcatctgttgtttcctgactttttaatgatggccattctaactggtgtgagatggtatctcattgtggttttaatttgcatttctctgatggccagtgatgatgagcattttttcatgtgtctgttggctgcataaatgtcttcttttgaaaagtgtctgttcatatcctttgcccactttttgatggggttgatttttttcttgcaaatttgtttgagttctctgtagattctggatattagacctttgtcagatggatagattgcaaaaattttctcccatttttgtatgttgcctgttcactctgatggtagtttcttttgctgtgcagaagctctttagtttaattagatcccatttgtcaattttggcttttgttgccattgcttttagtgtaacttaaaacatttttaatagatgtttttatatttttctagtgaatccactccatgacatcaccttgccttcctcttttttttttttttttttttgagatggagtctcacttggtcgctcgggctggaatgcagtggcacgatctcagctaactgcaacctccgtttcctggagaatcagtgaactgattctcctgtctcagcctcttgagtaccttggattacaggtgtgcaccaccatacctggctaatttttgtgttttgggtggagacagggttttgccatgttagccaggctggtcttgaactcttgacctcaaatgatcctcccatctcggcctcccaaagtgctgggattacaggcatgagtcaccacgtctggccctcgccttcctctttatgccagtttccgaagtcacatgtaagcccttaggcagatggtgggatcctcattctatcactctatccctttatggttttcttagttgtatctttaggtggagtgaagcgggacagctaacacagtgacctccagtagccacagaatttgttggtatttgctagaaatacatttggtggataatatggaccatcaaagctttactttgactccaccctgcaattttgtccaagtgtctcaggaaatgactgcacttcatttttgctgaagcctatttctctgcagtacattttgtaatccttatgggttttatcataagaaaaaacaactcatggtctttctagaaaaagtcaaacattggctggtttcatcgtttatcagcatcagctctttctgctgataatgctggtaacaaaacttctttctctcagcacctctttcagcctgactgttaaggttttgatggagaggaggtgggaagcccaggcttgactctaagcctaagccacacttgtcaatgcagttaatcagaaactttgcattgttactggcccctgcccaactagggataaagatgacactttacttagattttcatgtgatctttatgtctgggaccaaccggttaaaatcccagaggaaggaagtttgggcaattggctagattccagcattttccacacactggattctgtgttagggatactaaaatgaattaataaaatgcagccctggccaggtgcggtggctcacacctataatcccagcactttgggaggccaaggtgggcggatcacgaggttgggagtttgagaccagcctgaccaacacggtgaaaccccgtctctactaaaaatacaaaaattagctgggcatggtggcgtgcacttgtaatcctagctactcaggagactgagacaagagaattgcttgaacccgggaggtggaggtagcagtgagctgagattgcaccactgcactccagcctaggtgacagaacgagactctgtctcaaaaagaaaaaaaaaaaagcagcccctggtccaaagtcactcccacatcaaagcaggtcccacctataagcagatatttataatacaatgtagtaagtaccatgataaaagaaatctttccaatctaactcatagaggaagggttcctggaggagataaacctcggtaaaaacattagtatgaattggtattagataaggtggccagaccatgtgatcaaataaatagagatgtgaaataaaaaggtacgtatgtgtgccatgataagtggtgtttctggagcagaaattatgtcatgcgttagtggttgaagaagtagacagaacctggtgaaacctgtttgttctctaaaagacttgtaatttatcccgtagattaactggtttttcccatggccagacacccacagatagcatttcaccctgtaataacttctcttgggtgtgcctaggcttctgcatgattaccagctcattggctgtatcagcaacccgttttttctatccagtgagtgtgaaagagatgaggtttctacggtccttaaaaagcctggatccatcagcattggagcttggagaggagttgaggtaaaagaaatgcaatctaccaacagatataatgtttaagtatcttactttttactgtaaaaagtatcaaactttttactgtagagttgaatcatttatacattttggtttaacctaattcaatttcttttcttttcttttttttttttgagatggaatctccctctgtcacccaggctgcagtgcagtggcacaatctcagctcactgcaacctccacctcccaggctcaagcgattttccttcctctgcctcccaagtagctgggactacaggtgtgcgccaccatgcctgactaatttttgtatttttagtagagacagggttttgccatgttagccaggctggtctcaaactcctaacctcaggtgatccacctgcctcggcctcccaaagtgctgggattacaggcatgagccactgtacccggccctaattcaattctttatgctgattaaagaatggaaaaagcaggagatgggacatgcaagggagaaagtggggacagtgtaactggcccagccaattctgtcctctactcatggtataagagagcatgagacaggaggactgacgttcatgccccatcatcagccttggtctcccatgtggctttcataacctgagtatctcttggagccaaatgggagtctagtgtttagaaatatgtgtttttcatacaacctgggtgctaaacacaagataaacggttcaccaaagaaccagtgagtgatcaatttttgctgggagacagactggcctggctggccatatgaaaaacccagcatatgcagttgactctctgtatctgtgggttccacatccatggattcaaccaactgtggatcaaaactacatggaaaaaaattgtgtactgaacatgtacagactttgtttcttgtcatttcctaagcaatgcaacataacaactatttcatagcagtgacattctattaggtattataagtaatcagacatgacttaaagtatatgggcggatgtgtgtagattgtatgcaaatacgacactgttttatatcgggaacttgagcatccaccagttctggtatctatggggagtcctgaaaccaattccccatgaataccaaggagtgtctgtattgtatttaatgggcactggaagggattcaagagttattttgattatatactctctacttgccttgctgagttttttaaaacataacacccaaatgggaagcaaaattactttgtttatgtttctcaaagacgatgaaggagacaaaaacctaagttcacagcaacctcatgaagctcctcttttatttcccatcctctcactattcttatatttctccagggcattcctccctccgcacagccctgtgaagctctcctatctcttcctctactctgtatccttttatttatttttattttattaacttattcactttggaatagggtctcactctatcacccaggctgaagtgcagtggcacaatcatggctcactgcagcctcgaatttctggactcaagcaatctcccctccttaacctcttgagtatctgagactataggagtgcagcaccacactcagctaattttaaattttttgtagagatagggtcctattatgttgcccaggctggtcttgaactcctgggctcaagtgatcctcctaaccttggcttcccaaagtactgggactatgggtgcgagccactgtgcccagcctacattcttctattacataagatgatcggagcttgtctccagccaacaggaatcattattatttctgagggactatgagtgggtgggcaaaaattgcattttctttttctttttttttttttttttaacagccagggtctcactatcgctattgttgccccagctggacttgaattccagggcttaagtgatcctcccaccttagcctcccaagtaacttggactacaggctatgccagcatgccttgcaggatttacattgttaatcataagatactctctgtgttatggaatgaattgtgtccctatgccccccaaaattttatgtgttgaagtcctactcaccagaatttcagaatgtgatgatatttggagatagggtttttacagagatagttaagttaaaatgaagtcactggggtgggccctaatccaacatgactggtgtccttataagaagaggatatttggacacagacacatacagagagaggatgacatgacaataccagaagttggtcatctccaaaccaaggaaagaggcctcagaagaaagcaaccctactgacacgttgatctcagatgtccaggttcttcaactgcaagaaaattaatttctgttattcaagtcacatagtctgtgatattttgttttggcagccctaatgcaccttggaaggggagatcacttagacaaacaatgcctgtcccattccactccagcctcttcaaatttatacatacaaaggagaaccactcacgaacattggtattttgtgtttttttggtcacgtattacttgtgctgcccatcacagcttactagaagactgaaaaacattgctgtaggggagaaggggccacaggggaattcaaagcagagaaggacgtgatggatctgaattttgggtggatcacaccaacatcaaaagtgaagatggattgaaatagggcaagacaggagatggagaactattaaaatgctttttcggctgggcatggtggctcacgcttgcaatcctagcacttggggaggtcgaggtaggcggatcacgaagtcaggagtttgagaccagcctggccaacatagtgaaagtccatctctactaaaaatacaaaaaaaaaaaataataattagctgggcatggtggtgggcacctgtaatcccagttacttgggaggctgaggctggagaaatcacttgaacccaggagaaaggaggttgtagtgagctaagatcacaccactgcactccagcccaggcgacagtatgagactccatctcaaaaaaaaaaaaaaatgctttttcattcagtagcagcagggatggagaattagggatgggtttgataaatatctaggtatgagaataataatattgggtgatagaattggggtgatgaaagggagtagagatggatgatttctatctttctagtttaggtatctgagtatacaatggcactgccaatagaaagcaactatagagtttatttgcatgccactgtattctagaaagaactgaagttggcttatacaaaaactgatcatgccataataaatagaagtaaatggggaaagcgaagctggctgtgcttgaaaactggaaagacaaaatgaagccaagagcgaggttagcacacaaatcctcatccagggattcttaacacttgtcagagatggactgtacattttgctttaggccaacacatgacattattcacacttgtcattttggtcaatgtttctcacctcttccaaggacctggagtctgaaaattctaaaacaatgaaaatctggctgttggcttctgggcgtgagaggcaccaggaatactgggagaggctcagattgcatatttggagactcctcagagagaaaggtgtggaaagtttaaaaagtgtggagcatctcctgcctcaccttagggtagggtggaatctggcgcttgggttcagagactgggaagatggactgtctgtacttccatgcaacagtgtaaaaatccattgatttgggaaaatgacatggatgtgtcatatgccttctgtggtgccacttgactgatttacataatattgctgtttttgctatgtgaatacacaggttacataagcagtctggcagcttaagtctcattactgtcatttccaaggtgttagattgttcagaacaagggaaccctttctgctacagaatctaaagtgaatgtatccccatctaggcacatttcaatgatcccttcatgatcacacctttggaatatgcccaaatagccagtttgataaccttaggttggaaaagggaatggttgttcccaagctgtctttcccagagtgtttccctcttgccaagtgttgagtgaggttcaacaggtttatgttcctgcctatggggcacctttctctatggagaaaggacctttagaaggactatatagagagaggtgagctctatacaacagctcttggcgctaataatactacaccttgatgggtccaggactggttggggcctgacttgctgatcttttttgcttttataatttcaacttttattttagatttaggtggcacacacgcaggtttgctacatggatatattgcctgatgctgggtgcgatacacatgatccagtcacccaggtactcagcatcatacccagtggttagtttttcaacccttaccctcctccccttcccctctagtagtcccccagtgtctattatttccacctttatgtccacgagtatccagcgttcagctcccacttgtgaatgagaacatgcaagtatgtctaagatggtgtctccactccatgcatgcctccttctagacaggatctggctggctgtgggcagtattgtggagttggtaagtttcctctgtgcgagtttactcttccttttctttcaatgtgtaccagagtgatgggattggctttggagtagagatatgactctctctggccagccaagcctggtacaagtaatttaactccttggaatctcagcttcctcatctgtaatgtgcggaagataacagcagcctcacaggactgccctgactgcaatcacaatggaaatgagtggctgtgaatttcttcacagcgtcctgatgcaagaaaggcccaaaatacttcactcattttattgatttatttatttacgtatttttacatacatacattttagggacacccaggctggagtgcagtggtgtgatcctagctcactacaaccccaaactcttgggctcgagcagtcctctcactttagcctcccaagtagctaggactataggttcgcaccaccatgcccagctaattttttatttttagtagagaccaggtcttgctttgttgatcaggctagtctcaaactcctgatctcaagtgatcctcccacttcagcttcccaaagtgctgggattacaggtgtgagccaccatgctcatccactttacttgttttaatcagagtaaatctggctgtaggctctcaagaactacagtgttgagaaaataaatcacagatttctttaggagcattccctaccaatccccaaagatataaatggtcttttaaatcccttatttgggatttaaaaattagggagggggccaggtgcagtggctcatgcctataatcccagtactttgggaagccaaggtgagcggatcgcttgaggtcaggagttcaagaccagcctggctaacatggtgaaaccccatctctactaaaaatacaaaaattagccgggtgtggtggtgcgagcctgtagttgcaactgctcgggaggctgaggcatgagaattgcttgaaccccggaggtggaggctgcagtgagctgagattgtgccactagactgcagtctgggtgacagagcaagacggtgtctcaaaaaaaaaaaaaaaaaaaaaaaaaaaggaaaaaacatgagggaggggcctggacctcagtccttggagtcaccagagttcctgctgctctttctgctccatgatgctcctgagtttgtcctgcttgctttctcagcctttgttctctcgacagacccagggctgttcctcaagaccattgtattttcttctagccagaagtttgaccacatggaattttgccagtgctgtccaagtcttggcactgtatccaaccaccctggtatccctgagatctgtgttcaaagacagcccagttctaatcacctgtgaaaaccccaaacctccacactcttcaatgttatgggaggccaaggctttacctgcctccaggcaccccaaaccccaactgtctccccgatctattttccttcctcatgaatgagcttatgtttcctaaacaaagctgggatgagtcttatgtcctggaagtctcatagtttctactgagttaatattgactctagttgtcctcagtagccagtttcttcttcactcacaccaacagaatgtttagctacacaggaaatgcctagaataaggctgacattttgcagcctgcctcatagctagggatagccatgtggttgagttctggacaaagagatttaggtagaaagtgtgggtggcagcttctgggagccttctttaagggacatacctgccctttgatgttcttttcttcttccatcttgctgtctcctatgcagctgctgccatcttggaccaagcacatgatggtcatatcctaaaagatatcagaatggtgagttggtaggagactgagtctttgtttataagacaagacacagagtggggaaaaccccttttgtttggtccaatgtcatgacaattgagcatcaaagggaagaatctcaaggaccaaggttacctgctgagcatgaccaaacccaagagagcccacgtccttaatgacatcacttacccaggagcctcctccctccagactccttctgatgggagatgagatgagacattttccccactgtttaagccacttttctttggatattttattgcctaagagcaccctaaccaatgggatataaagaagaacagtctcagagcacaagggttgtttacttgtttttcagatgaggcagggaaaatccctcttgatcttttgagcatccttcagcaacaagaacaaacacaaacaggtatctcagtaaatgatgcccccatatgtaaaaaacacagcatggaacctgacacatttaagcagtcagtaaaaggtagctattcttctttttcttagtagcataatgcctcaataaacattggtttctgatcctatccccttgagtatctctccctttgctgctaagtttctccatacctttacatttatctcccttctcccctattaaacctggctcttgaaaagactgtcaacttgctctcattgaggtgtcagtgatagataaggcttaatgtatgacctcattccccaaacactatcggcttgtcagtgagatttacatttaatagaggattaaagccttaagccaaaggaatgaatctttaatggtgaaatttgaggcaccagaaggcttatgaaaaacaatattgaagagggggaggacctccttggtgatcccaattttctgaggcattctcataaagttctccaaattctcccaaatttaaaaacgtcatgccgtactgcacttcacaattggcagttggcagacagattctggatgaagctttgtggaactgaacgggagtgggagggggaatcgtgaaatcaaaggcacaagaagagggtgtctcaattccagagggagttgtctgttgagtgggtgagtcaggctgtctgagcatgtggatggaacttccctggggcagctgcctgtgttgagccacatttgatattgacttagcagtttcctgctgcttcttgaccttttttttggttggggctggtggttgagctgtatcaagttatctttctatcccaccctcccagtttcttccctgaacctcatcatcatctcagttcttctccctgcttgtcctgccctctacaaagtgcctctttggccaggcttctcaaatactgtgagcaagacttggaatctctcttctctccttgcacccaccactgaatctttgggcatcttggccgggtccccagcagtgcagacctgacaggctgcattcttggtcactgggatttcttctctgagctccagcttatgctgcttccttttcagcatctcctcttgagtatcccacggattatttatttagttatttattttaattttttgttgttgttgagatgaagtctcactctgtcacccaggctggagtgcagtggcatgattgtggctcaatgaaacctccgcctcacaggctcaagcaattctcctgcctcagcctcctaagtagctgggattacaggagcccaccaccatgcccggctaattttagtatttttagtagagatggggttttggcatgttggccaggctagtcccgaactcctgacctcaggtagtacgcccacattggcctcccaaagtgctgggcttacgggtgtgagccaccttgcctggccctgattatttatttttttgagatgaggtctcactctgtcactcaggctggagtccagtggtgtggtcatagctcactgcagcctcgaagtcctgggctcaagtgaccctcctgcttcagcctcccgaggagctggaactgcaggcatactattattagtgcttggaacacttagcaacatacccagctacgttgtaaattagagacgaggtctcactatgttgcccaggctggtctgcaacttctggcctcaagcaatcatcctgcgtcggcccgccaaagagggaccccactccaaagcactgggattacaggtgtgagtcactgtgcccaacccctactgatactttaaattcaacacatgtgggtcaattatgttccatccatcccctggatgtgctcttcacccacctccaccttgttccttccatggcagatggagtcattggaacgtcatcacctctggctgggtttgaccaattaggaggagaaaggagagaggagggaggagtgaggcaggagtgggaggctgcagtgttcatcccctaaaggtggtctccgccggattgtgttcctccaccaaaagcctgctcctttctagtggccttctgtacctacacgactccctctttccaggtcttggcaactattccctgtccttgttcccccaagcttggaggcagtggcagctcctccactgctgctggcctcgggtgactgctctcacccttgcagtggttcccttgcgggagattggcatcacctggaaacacattaaaattgcagacttggggctacctcccagcccttctgagcttgaaattaggggtggggcccagcagtctgcatctgtttttaatttttatttttattttaagttctggggtacatgtgcaggatatgcagtttttgttacattggtatacatgtaccatggtggtttgctgcacctgtcaacccatcacctaggtattaagcctagcatgcattcgctatttttcctaatgctctcccttcccctagcccacccctgacaggccccagtgtgtgttgttcccctccctgtgtccatgtgttctcattgtccagctcccacttctagctgagaacatacagtgtttggttttctgttcctgcattagtttgctgaggataatggcttccagctccatccaagtccctgcaaaggatataatctcattcctttttatggctgcatagtattccatggtgtatatgtaccacaatttcttgatccagtctatcattgatggacatttgggttgattccgcagtctgcattttgaccagatctctaggtctaggtgattctgaagcacgctcatgtttgagcatcaccaaacttcacctttccagctttgaaattagtaacaaactcttccaattgtgccaaatgaacatttcctctgttttctattgtgatcctaatgatataatgacaataataataatagaattcagatccccggcataaaagtgacccttgtctagggtctctttctcaatgaatgcaacaccatgggacttgttcttacacatcttttaactctgcacctaccagcctgtgtggtacattgtaggtgctcagtaaaggctcatttcaacagaaatttcatttttttaccctcatggttttgtgcctttcccaacacaccgtgtatacatccattcatccacccaggaatcaccatatgggtactggggatgtacagccaaatatgatattgtgtttagtctcatgggtcttatgagttaatgggtgagatgtcagctgtctgagtttcagtaacaccatctattaatggatcataatattactgactccatggggttgttgtgaagatgaaatgggataacgcacagagtgctcttggcacggtgcctgacattgaaactattcaatcaattttagttttattactattgcagtagttgatatagcttaagcctggctcaaacagagacgagaacatgatttgtgggcatctctccacgccatgggtataagcgtcttacaagttacaggatcattaaagtactttgtaaattacttggcatttcataaggcgtttatttttattttttaatttttgtgagtacatagtaggtgtatatatatatggggtaagtgagatattttgatacaggcatgtaatgtggaataaacacatcaaggtaaatggggtatccatcaataaggtgtttttatatttactgatctggctattattcttgtcctcgtgtgatatctctgtcttgtttatcctcttcaaggctaccctgtaagtttcattttgacctgcttttattcctgtgcaaaagttagccagcacaaaagagtagcttaataatttattctggattgagacgcccttagggtctgtccattaatttcttcccttccaaaatgactataattttttattgtttttattggttaaaaagatgtatgttcattgctttaaaaaatgaaatgatacaaagcggtacaaagtacaaaatactttatcagttgaaataaatcactcagagatacctcttttaacatgttgctgaaccttttccttgaaatatcattatacatttctctgcaactctatctagtatttccatgttacatgaatagggtcattctatggagccagctcactttttagccagaaactatctgaggaggctctgggaaaatttcgtctggggaggcgcgcttgctctcccacaggaccaccagatgtcgctgcttctgaatttatcagaatttcctgtccccagggcaggctgcagaaattaatgctcaatgttccaatcctgggccctggttcgtaccatccctctggcctagggctgaagatgaattgattttgttttcagtgacacctgcagagggcaaaagtcatgcccacactgtgacatggagtgaacctgtagtggctcttggactgaacaagttctgacatgtgtgttggttatgtttgcacctgttttctcctcctcccccgtccccaaattagatcgtgagatccctgcaggaagagactgagtcctgtaacccagagttctctttctgtaaagccctcaatacctgttaagtctcaattaagaataaggtagcttggggacctggcatggtagctcacacctgtaatcccagcactttggggaggcccagttgggtggatcacttgaggccaggagttcgagaccagcctggccaacatggtgaaactctgtctctactaaaaatacaaaaattagacaggcgtggtggggcatacctgtaatcccagctactcgggaggctgaggcaggagaattgcttgaacccaggaggtggaggctgcagtgagctgagatcacaccactgcactccagcctgggcaacagagtgagattacatctcaaccaaaaaaaaaaaaaaaaaaaaaaagaaaaaagagatggtggctaggaaaatagaggctagaaagaaaaaaaaaagtaggtgttttgaaagcagaaaacaaagtataaaaaattattgagctgggagtcagaaaatccaaattttacatttggattaggtcttaattcactggctgactttggacaagcctattgacctttctggggtcaagttggtttatgtataggaggttggatagaatgatctctcaacctctattagctctgacctccttggatacaaaagttcttcttgtcttttgttgttgttttttgtttgtttttgggatgggaggatgtcaaattgcatctagaagtgaatcattgggcaccgtcaagaaacctggggaactcaggtcctggggcatccagggcaggtcaggcctgaggctgagctgcacttaacaatccaccctccttgcagggccattggcgccggccgcaccagcacagcccatacatcattattagattcccttcatcatgctaattgacatgggatgaaaaatatccagtgaaggaaacagcaaatgctttcacattcagccagggcacctggcaaatgggagaaactgctgtaaaagttaactgagattgaaaacgggcctactaatatcttgtagggtgaatgtttcctgttgccgggaactagttcggattggcaatgtgagtgagtggtggagacagggagggagggaagcttggggtaccacgtgtgaagtgtagaggttggggggaaccttttaagacagtttaggttcagatgcatggagaaccagacagaacaaataaagaaggatagagaggagagagagggagctggtcttgtctcctctaaactgtagtgataattgtacccccttctcagtttgaattctgttgagaattattttctcaagaagagtccagtattgggtggaggggaatgtagaattcctggctctagaccagtctgggggtagaggaggttgcaccccaggggacattaggtaatgtctggagacatatttggttgtcataagttgggggcgggttatattagcatctcctgggtaaaggccagggatgtggcaaaacatcctacaatgcacagggccaccccctcccaccaagcacataatgatcccgtctaacatgtcaatagtcctgaggtgaggaagcccggctctaaaacaatgtgtgactttgcacaagtaactaaacacctccgggtgactattttatcaatctacgtgacaaattttacatggtatggtagattgctggcaaaaatagcccaaattctcctccatgtcccccctggccattgcaatatcactttgcagctcctgctatcaagacatggagtctgttcctcactctttgaatcacggctagcctgtgtcttgctttgttcagcagaatctgcagaattggtagcaccaagtctaggcctcagaggctttgcacagttctgttgtctccttccgagccctgctctcctgtgtgcgtgagcctgggctaatctgctggaggatgagacaccacgtgtacaacaggcaaactgccctaccctgtctatgctaaaaatacaattgctaaaaattgcaagatacagtccagcctagagtaaaactatctactgaccgaggaccatggactgcagaccctagctgagataagaaaacccacccaggtaatccatagtttcctgggagataacagattcgtactttttttttttttttttttcctttgagatggagtttcgctcttttacccaggctggagtacagtggcacgatcttggctcactgcaacctgcctcctgagtagctgagattacaggcacccaccaccatgcccagctaatttttgtatttttagtagagacaggctttcacttgaacccctgacttcgtgatccgcccaccttggcctccctaagggctggaattacaggcgtgagccaccatgcctagctccagattcttactgtttaacccactgaatttcagggtggttcattatgcaacaatagctagctaatatgcaaggtcttgaaattaagactcaacggtgaattccaaggggaatgggaaacatctcaagatttgcttcctttgttaatagctgacattttcctaagtccgatagctttaaatgaatcaagatgtgcataactgcatcctttgatacccaattaatggagctgggcaagttctatctggagacaagtttgctaaaggttaattttattcacttttatcaggacaagttgcagcaatcaactctgacttaaacaatagcgaaagggcattggtgaggacaccaggaagctgatgaatacacagccttcagcaacatcgggagtcagagctgctccagggatcttggcaggagggatttgtggctctccttccagaatgctgtcaagggtgacagaggcctaagcacctttcatcctcatgtaatttgtgctccagatttgaagaccagggtggaagaacctcattggctttccttatgtcacctgctctgctaataggtggtatcgtttgattggcacctctgccattcccacgtagagtggaaaagggcaatcagacagaaacagaaggtgccgtctgcctccctcctccctaccccttcccctgccacccacaaccctacagattgggaaaggtagaattaggaagtatgtttagaatttttggtgtgtggtctggacctctaagatggctcatcatagcctagctggaaaatggaaagcctccgtcagaaattaaaaatcaaatgtaacagtgctgttgactctcatacgactctcctccagtcacccttcacttgtcatgtcagtgtcagcatttgtggtaatggtttgggatgtggaagggggagtgagaagggagataatccttcttcttctccttcttcttctgagacagggtcttgctttgctctctctcccaggttggagtgcagtagcatgatcatggctcactgcagccttgaactcctgggctcaagcaatcctcctggctcagcctcctgagtagctcaggctacaggcatggaccaccccacctggataattttattttttactttgtaaagatagggcctcgctgtgttgcccaggctggtctcagactcctaggttcaaatgatcctacagccttggccactgcacccagtcttgatctgacttttgaagcactatgtatttaccgtactccagcctgggcaacagagagacatcctgtttctaaataagtgttatctcttagtgctatttctattcttgttgtcagcttgcaagttgatagctggggtcaaaagtgtgacagttgtttgagtcagatttggaccagaacattttctgccacttattccaaggagatggcaagggtcagcggggggtcctaaaagtctcgggtccagacattaagtttctgccttctgtaagtcacccaaagatccccaaagtgtcccagctgtagagacacatgaattacctacttcccacctgtaaattaggagggctgtacacaatctgaggtttacaactatttttttcttttaattttcttgaacccttcaagtaaaatcttatgttgaagttcagcacatataactgataaatgtgagtcattttcatagaagcagttgttgtgtgtgttttggggcgcagtggggagcagggggagcaggttggagccctactcatatttggcctccccctcttctccaaagtggctctgaagacatctctaggaccctcttggttttgaggaccacttgtgaagaccatgggaccagtgacattgaggcctttccaagctttgagtacaattctctgtgtgtagatttgaggaaatggtcttcatcagtgctgagatacagaagatagacctggtggagaaagccagggggatggcagatgctggaccaagccattctcctgcctcagcctcccaagtagctgggactacaggcgcctgccaccacgcctggctaattttttatatttttagtagagatggggtttcaccgtgttagccaggacggtctcgatctcctgacctcatgatccgtccgcctcggcctcccaaagtgctgggattacaggcgtgagccactgcgcctggcctcttcatctccttttttgcacaaagcagcacagtgaggcagaagaacaagggctttgcaactctgatcccagctatcgacttctgagctgacaacaagaatattaatagtaccaacagctaatactttttttggggggatggaaatggatttcatttggcatttttaccaaagatgagggtgttccctagggaggtagcccagcagagagcttaagagtctggaatgttgaagacgaacagtctcaggctgtagtccccccagtcctgccacgtgttagctggatagtctctttatggctctgagtctcagttttctcaactgcaaaatggagaagcaacagtatctacttcctagagctgctgagagaatttcagtgtaatgacgaatgggaggtgcttggagagtgaaccttggagagtgggtaaattctacaaaatatagaaaaattgctcaggtggagagtgtacatgaatggagggtgaaagcagcagccaggtgtggtggctcacacctataatccaagcactttgggaggccaaggcaggaggattgcttgaggctaggagtttgagaccagtctgggcaacatagccagaccccatctctaaaaaataaaaaaaattagctgcctattgtggcaggtacctgtagtcccagctactcaggaggcagaggtgggaggataatttgagcccaggaatttgagaccagcctgggcaacatagcaagaccctgtctctacaaaaaataaagtagccgggcatggtggctcccactggtagtgccaactacttgggatgctgaggtaggaggatagcttgaatcccggagttagaggctgcagtgagctatgattgcaccactggataactccagcttgggtaacagagtaagacctcatccgcccaaaaaaagtattagctgttggtactattaatattcttgttgtcagctcagaagtcgatagctgggatcagagttgcaaagcccttgttcttctgcctcactgtgctgctttgtgcaaaaaaggagatgaagaggccaggcgcagtggctcacgcctgtaatcccagcactttgggaggccgaggcggacggatcatgaggtcaggagatcgagaccgtcctggctaacacggtgaaactccatctctactaaaaatacaaaaaattagccaggcgtggtggcgggcgcctgtagtcccagctacttgggaggctgaggcaggagaatggcttgaacccgggaggcggagcttgcagtgagccaagactgcgtcactgcactccagcctgggcgacagagcgagactccgtctcaaaaaaaaaaaaaaaaaaagaaaagatgaagaaaaaggagggcacctctcacctttgctaggagtttgctcctaacattctcttctctaatgctaggggtcccagtccccattctctctcttacaaaggaccattcacttttcctgtcgtcccctgacaagacctccaggagcgaaattaaagcaataagagctaaactgtctgtgatcggagaacagagaatgtgataatgatatataaagcttaaaagcactaagtgggcaaaactggtgctagagaagtgagtaaaaccaagacaaatccgtcccttgagagctataacacataacttaaataaccggagcagcaggggtccgttatcccttggaagagcggtttgcactcccgtggagcacagcctctgcccagcatccataattccccatgtgcttaggactggtcaccacagcctcagggttaactgctggttggatcagggtttctgctgccacctgggcacatgcagcccaccctatctggcagcagacatctgaggtctaacctcagcagtaagatggactggagaaagaactgcatggacactgagaggactcagattttgtttttgcctccaccctttttgagctgtgtgaccttgattaagttacatcacctttctgaagaaccctgtcttttttttaaaaaaaactttctatttaaagttgtgggtctcaacatggggtccctagaggaaaagcatcagtatcacttgggaacatgttagaaatgcagattcttgggccacaccgcagacccatgaaactagaaactctgggggtgtctcctagaaatctgtgttttaacgagccttctggtacatgctgaggttcgggaatgagtcttttaagaaaaatgatcccaacttgtgtttttattccctggcatccttaactcgttaataaggagggaaggagttcaatgttaatgggagctagctgggcttccaggaagttcctgggctaagtcacaagagcttttgttccaggagacatttggggcatgctgaggcaggaggatcccttgagtctgggaggttgaggctgcagtgagctgtgatcaagccactgcgaagtctccatacctctctaagattcactgcaggtgtgtgtacttccttcattccaggcccagctgacttttttcccttccatagtcctttgctctttcccccttcccttctcccagacacaagaaatgctttcagtctgggaaaagttcagggaggtgggaacttgtctctacccaatagcaatttttctatattttgcagaatttatgccctaattccttttagccgtgggcttttgaagctcaaaagctcacgtttggaaactcacaatatgaggcatttgaaatttaaagccttttcctttgcttttctgcagcccctttattaagcaaataaatgctgttaaatcgagttgctgctggagtcagggaaaggaaagagagtgaggagtaatgagagtgatatggaggagagagtgcagtcaatgatttcaaaggtaaatgtctttccacataaacttgtgatataaataaagagaggaacaggcattctgctgaacatctctgggcaacattaccctttatttaaaaaactctacacgccttattttatggagagttctggaacccaagataggaatgtcacttatgtgcatattcttacgccagctttccttcccacataccattatgataactctccatccctgtaaataaccagggggtctctcttccttctgacccttgcacaacgtagctagctggagtgatccatttcttcttcttcttttttttttttttttttttttttgagatggagtctcgctctgtcacccaggctggagcaatccatttctatctttcgtgacacccgtctggtactactttgagaactagatgaaaactagaagtgctttttgtctatttaaaaaccttattatgctggtttcaatgtgttttttggtagttacagttctgagaagtgtggattttgcagttccacactgttaagcatgatctcactgttgtgtatctgggtaaaaggtgatttaaaggcatcgcaaggagccaagcttccatctgatgagaaatgcaaaaagacacaagggggccattcctggaagtgtgaaactctatgttcaacaggaccaagagacgagtcggttgcatatttacattttacatttatgtgatgcattagaatttataaagcgtattcacatgcattaatcactaagatggaattttaacaggcaactggtacgagctgcattggaataagagggattgatagtatttaaggaccagtcagaagaggactgatggtatttaaggaccagttacaaaacaggctggttgcagtgactcacacttgtaattccagcactttgggaggccgaggcaggaggatcacttaagcccaggagttccagatcagcctgggcaacatagtgagacctccatctctacaaaaaatgttttaaaaaattagctgggaacggtggcatgtgcctttagttccagttacctgggaggctgaggcaggaggatcacttgagtgcgggggggggttgaggctgcagagagctacgatcacaccactgcactccagcctgggtgacagatcctgtctcaaaaaaaaaaccaaaaacaagcagaaagtgaaaaaatagtgacagagtatatttctttgaatcatgccttcaattgcatgtgctccttggttaagaacactcattgaggattatatttaacttttctgttttattttatatagaaaaacccatattagagcaaaatataccttagtagtggtaagctgtggtgactctaattaatactgctttctaactactctacaggaaaagtgatctacagggtttacctgtagaaatacagcagtgccatagccaggcgtggtggctcacacctgtaaccccagcactttgagaggctgaggcaggtggatcatgaggtcaagagatcgagaccatcctggccaacatggtgaaaccccgtctctactaaaaatacaaaaattagctgggcatggtggcacccacctgtagtcccacctacttgggaggctgaggcaggagaatcacttgaacccaggaggcagagattgcagtgagccaagatcgcgccattacactccagcctgggcaacagagagagactccgccccccccccccaaaaaaaacaaaacaaaacaaaacaaaaaaagcagtgccattaggcactagtgccagagtggttgcatgcatctggattccctggaaattcctgggagcgggagtgacagagcccagtcctgtcactgagtgggttcttaagatgaccacggttcctgttttcccacagccctctgtcaagtcttcaccgacgggcagacagcacagttcacatttcagtcacggcactggcttgcccctcttgcttggcagagaaaggacagtgactcccttacctggaaggttgtgctcttatctaacagaaggaaggtgaagaggtgcagagcagaggatgacagccggggggcaacatgacttttgctggatgtgagaaatgccaagtcagtcgctataccgaccttagttcttcagccccacgtcccatttgagacgcatattcctgcattctagggatacacccaactgacctgtttcatggagggaaattagagtttggctttggctgtcagtttctgaaaggaattaaagggtttgctcctcatcctccatgccgtgctataatacaccaaaatgaccacccggcagtttgcagctgaactcagacatcatatagtcagttacatctctctcgtcagataacaaatgtcttggaccccactgtggaggggtaattggaattcagctaccgtgggaactctaccttaattgccatacaggatgacaacaagggagcccaaatagcagaatacatccctgtatcatttttttcttggcttggcagaggtgtgtgtagtgctggtgtattagggttctcgagagggacagaactaataggagagatgtatatataaaggggagtttattaaggagtatttactcacacaatcacaaagtgaggtcttacagtatgttgtctgcaagctgaggagcaaggaagccagtcttgagtcccaaagctgaaggacgtggagtctgatgttcaagggcaggaaacatccagctcgggagaaagatggaggccagaagactaaacccgtctattctctccatgttctgcctgcttttattctggccacactcacagctgattagatggtgcccatccagattgagggtgggtctgcctctcccagtccactgactcaaatgttaatctcctttggcaacaccctcacagacacatccaggaacagtacttcgcatccttcaatccaatcaagttgacactcaatattaaccatcatagctgggttctgtcagttgctctcccaggactttccagggaatacagattagtagagatagaagaagataaggaaagactattgcatggaagagttgccttagtgatgatgaaattggagggaaatatgtaatgctgctgtgttggaatcttccccatgaagaatgctttcccaccttggatctacagagatgtcttttgtaatagggtttggcagaaaaagcaacagactaggagtcaggcggtctctgctttgctatttacatccacctaattcgtagaacccagacccaacctgcaaactactaagtcctggcaaaaccgcagccattagcatgggatccacattcccagtgcatgtttagatggccttctcttcaccctctctgattcctggttaatgttttctttgccaccctgacttatgagtatcaggactcatgagcagcaagaaatagaaaacccagctcagactgactcaggccaaaaagggtatccgttggcttatctaattgtaggcattgctgggtataaggactcctttgatttgattgggactcagtttcttgccatctctcagttctgagttccttttccttgactccactttttagcagggtctttcctcctgatgatgaaatagttgccagagatgctaagcttatatcctctaaagcttcaacttcagtaaaacagagagccaacttctgtttcagcaatgtcagtagtgtgtgtcactagctttggaagggtgattctcctgatttgggactagatcaaatgttccccccagcgaggtgtggtggctcatgcctgtaaacccagcacttttggaggccgaggcagacaggtcacttgaggtcaggagtttgagaccagcctggccaacatggtgataacctatctctactaaaaatacaaaaattagccgggcatagtggtgggcacctgtaattccaggtacttgggaggctgaggcaggagaatcgcttgaacttgggaggaggatgtttcagtgagctgagatcacgccactgtactccagtctgggtgacacggcgagactctgtctccaaaaaaaagtacccccgccccacctctgcaggagaggaagccccactcgaatcacttgggttaaaagtaggggaagggttaatctcaggtgaaaaggaggtagtactgttgcaagaagagggactggatagatgtgggtgacccaaccataactacctactctccctcagctcccaaaacatagctcaagcgttcctcagtagcaggaattttacaaaacactgctgcaagttccaataagaggtatgttgcaaatacctaaaattagctggaatttgtaacgagtttttatttttaaaaataagttagagtggattcagagttatcctggtaaagctttcagtgatggatatgtgagcattttaatacggttggctctatttgtgtaaaactttgaaaattttcacaacaaaaaaggtatcccctaaagaatatcaattttactcatttgttttccaaaacacttttttttatatgggaggtaggttgtcagagaaggggtgctcaggcctgcttgttagactagagaaggcttcctggccaagtgacagctcaggatgtgggaagtagtaacagccaagtgagtgcattttttttttaagagatgggatctcactctgtcacccaggctggagtgcagtggcacaatcacagcttactgcagccttgacttcctagggtcaagccatcttcccacctcagccattctagtagctgggactataggcacaccacaccacctggctaattttttattttttgtagagatggggtcttgctatgttgtccaggctggtcttgagaccagaactcctgacctcaggtgatcctcccacctctgcctcccaaagttctaggattataattatgagccaccacacctgacctgcattttgaatacaatatgagaagggctttgtaaactgtaaagtgccataaaagtattgtaagtatgtggtggaagaatatttttgaaatattaacatgattttcccctcagctttttttcccattcttactgcctttgttttctcctcactcagctaagccaatctatattcattctatcaggaggaagactatgacagcaggagaaagaacaaagaatcttctaaggggcacagaaaagagagagttattaagtcttccccaccaccagactagtaaaaagattccctagactgggagaacagagagagccagaagttctatgcctgaagctttccaatgacaaaataagaattccccatggcaggtgaatgggtaaatgatggaagtgtcctatgcatgaattattatgtagcctttaaaacgaatgcattaaatctatgccagttcatttggagggggcttctggtttacaacaccagcgagatgtagacaaagatgctacaaaattcctttttgtagaacaaatgatgcccagcccccattattaacatagacatttgcatgtttgcatacagttgcatgagcatgggcaaaaagtatgaaaagatacactttgcttcctaacactatttacctggggagagaaaataagtgggaggaatagaaacttaaaaagtatgcacaataaaaaagcatttgtggcaattccatttatgtgatattcatatgtatacatacgtgtgtgaatgcgtatgtgtgtatgaaaagattaccaccaactcaaatggtacagatatgtatgaagaaactcaagataaataatagtaacattttgattattgagtttccttatagttatctaaattgttcaaattattttctcaagcttcatgtattttcccacttttaagcaggcaataacagaaactatcttaaagataacacatttaaatttactgacacacagtaggcacctaataaatagtttaaagaaaataagtataattctcaaaattcaataaagatcttgtcattgtggagacaaaaagaaccacgcttggagagaagccagagatagctgagaagatgctcactctgtcttctccttgaaagaaaagccaacacagatttaagaggtccaaaaatgatagagaggaagagagagagagagaaagattttcaacctgctgcttttcaaccaaaacattgcagcaagggctgcaagccacatacgtggaatatactgagaatttagcatctgatcatgagcaaactcagagacatggatggtccttcctgctacttctttgagtttgcagggcttggaggctgtagcagtgagtggtgctgctgtcctaatgtcctgactataccgggagccactcttcgatcattcttctgtccattcagatgagtagagatgggctgcatgaacggttttatccccaggatcaagtggagcatctggcatggaacagccagccactcagtaagtgctgggtgaatgcataaataagtaagggaatgagtaaatgaagggttgagtatgtgagtgagtgagtgaatgggtgagacaatggatgaatgaataaatttgcaccccagaagaagctctgacacagctttgaattactcctccagatgcgaggggctttgtggagagctgtccatcatccttgcctgcccaaggacaatgacttctcagctttcaccatgcatcctgcagccatggagggaagcaaaattaactggtctccatcagcctccccatcaaacatttgctgagcacccatcatgtgcaaaatattgactaggaactgtgggagatgggaagaattctggaaactcctaactctcaaggaatttgcagggttatcagacagttgccacacaaagacataaaaacatcccctgctaaaataaagaccacgccagatatgtgctgtaggtattcacccctgcaggaactctggggaaaatggggcaggaggagtcacccttggatgtcacaaatggctctccaaaggaaatagaacaacatcgcagcatgaattctgaagccggcccacctgcctgccttgaattacagcttccaccagctgtctggccttggacaaactacttaactctccacatctgtcaaatggggataataatataacaatcccccaatattgtgaggatgaaataagctaatacttaggaaaagcttggaacagtgcttggcacgtcttaagtgtgatatgtgtgagctccttccttgattctcattctgacttgaagaggatttttagaggggagacccagggaacagtggggcagcctagacgggtggaaagtgttatgctggaggcttaacctaacctggttcaaaacctggttctgctatttctaccagtgtgaccttgacttaaactctccaaagctcagttcctcacttataaaatggtaataacaaaaccaatttcattgaaaacgtatgctaacgatgccatgataaataatagttattattaaagagaaacacagtaaagaagttcccagagggaggtgaataaattaagcatgatgacgtgccttgctacttccccatctttctcttcttcccccagatttgttcaaggtctcatcattactggtttgcatttctattttaatcatgttataggtttacagtatttttccccctgcatctttatatgctataatttgggtactatttttacacaacgaagccatttttaaccgagaacagattcaattgtctttcagcatatatcattgtttatcttaattaatgctaaaatattcttagggggaaaaacacatcccacagagtattatgcgaagaaacttagcattcatttttgcctccctcttttctggcatatcaatttataaaggttttagcatcctgttatttcaatgacaataatgcatgctcttaaacgcagacacccatctgtgggaagcaagtcacagggtgtcaacagcagcaaggtgtgtgttgcagtggaggtggaggattgacagctggaagaagaaggggattttgctggtgagaataatgccaagtgaagtcataggctttgtctctgattgatccatggaaacattccttgagtagagctgaatctagctagattccatgcttggagtctttcttagtaaggctactactataagcacagatgatggaaaatggatgatgtttttattcatcatccattctctttccttcaaataagatgccccatgcacctctgagggaatgaccctttacacactcaacctaagttttttgcctctccctccagctctagggtgggcatgtgatatagaactgaccaatcaatatctattatctttctggccacagtgattgggcaagggatagccatgtgacccaatcagagccaagagactcagttttgaggctttagatagaaccactgggaaagagggttctctttctactgggatgctgacctggcaggaatattacccagagctgcctgtgaccatctttactatgaaaaggggagagcttgccaaagaatgaagctgtattatagtctgttctcatgctgctaataaagacatacctgagatggggtaatttataaaggaaagaggtttaatggactcaaagttccacatgtctggggaggcctcacaatcatggcagaaggcaaacgaggagcaaagtcacgtcgtacatggtggaaggcaggagagcgtgtgcagggaaactccccttcataaaactatcagatctcgtgagacttacgagaacaacacaggaaagacccgcccccatgattcatttacctcccactgggtccctcccatgacacatgggaattaagggagctacaattcgagatgagatttaggtggggacacagccaaaccatatcagaagccaatatgaaagaaaacagaactgagagatggaggcagactcttgatgacaactcctggaccctggatcaatttttgtttaaagccagtctgcactctgcatctttgatgtaaaccaatgtatttcctttatttgtttgtttaaactaaattaagtcatttgtaatttaaagagttcagagaggtgccgtgtttcagtagggaactgtaaaaagccaggatattctgtaaattagaagggaataatgtggtgttgaccacatctgggagaatgtgcatctgagggtgtcttgcatgccaaactcacttgtcttcctaatcaagcaatagtttggtaactgagaagttccaagtagcctttaagtcacacaatcatactagaggaactcctaagaacctgggtgacattgtgatataaaatgtggaacttcactaggttatgcaagaacctctgaaaagggttgataggaagggtgtacgttaggtgtgtaaagaactaggtgtgggggaactaactagtacaaaagggatctggtgaatttggattctaccctactcgagatgatgttggagggctctgatcaaagtaggggtttgggggcagaattatgacaagtatctataggaagtcactatcttttattaaaaatttgttgtgaacctgtcctcactcatagttgggaattgaacaatgagaacacatggacacaggaaggggaacatcacactctggggactgttgtggggaggggggagggatagcattaggagatatacctaatgctaaatgacgagttaatgggtgcagcacaccagcatggcacatgtatacatatgtaactaacctgcacatttgtgcacatgtaccctaaaacttaaagtataacaaaaaatttgttgtgaaccagatactgtactaaatgacttacctacactgttgtatttaattctctcaacaacctgatgagttctgtatcttattatatccattttacatgtaagggagctgaggcttagaaagctggagtgacttggtctgccatggctaggatttcagctcatgtctgtatgactcgaaagcatctagtgggtggtaacattggtttgtagacttgaaacaactttggctaatgactggggcacatggaagaggggacagagtccagcttccaaagttagaaggctaccaaaactaaggttttggtcagagattcaacattccaggggcagaccctgatcccaatgggagagtagatttgatagggaaactgaggcaggatcctgggactggagccaacacagggagcattagttgggagggttgttgtgaccagtcaacatacttctgggggcttgtggcaaagaacaaacacagaactccaaatgaattccctgccagagcttgttcagagttggcttgggataggagaatctgaggggagtatgaggctgacagagaaaaaagagagtcttgtggaatcctaagatttaaaaagagaggaagaaaagatgccttttatttattaaacagtgattacgaaatacctaacacatggccacgattagactaggctcttcccatacatgaagctcagagaggtcaagtgagttgttcagggtaacacaggagctgtgcctgggtatgaagctgtatctgctcaaacataaaggtcttttcatggtgccagagtctacatttcccagagtactaagatagtgacttgatcatcagcactaaatatgtgtcgtaaagatagctcacatttacagatattatagctactctgtgccctgcaaggtgctaacgactttacttggattatctcaacttatcccccagacaacctatgacgtttagccaggcatcatcatcatcatcatcatcatcatatcatcgttatcctcatcctcatcctcatcattgttcttgaatgatgaaaattggagctcagaaactcaacctgtgtcaagattacaaagctagcaattctgggtcagaacctgaacccaggcagcccgcactttcgatgtgcccaagcttatatctccacctacaactctgcctcagtttctccctctgtaaaatgaagacagtaataaggcacctcacaaggttattgtgagaacaaaatgaaccgctgcatactaggagcttaacagactggcaaagaaaactccatcaatgttggctttcatcggggctattttaatttttgcatcaccctcttcaaaagggcacttctcgctttcccacggctaagctgccacactcaagtgtgctggaaaaaaaggctgggtagctcacaacgtgcgggggcatcttagtgtaatcctggggtgagagataaaagaagctcgcttgacataacttcataaacccattttaatctaaacattgattttcctttggaacaatccctttccccttgctcacagtcccaccacgcctctaatacagacgtgggtattgataacattattgagataaaacagtcgcctctttcttattccctttattcatcagtcaccccaggcctgtctttgtcttttttcatcctctgctacccagcattattcattggagtgccttcttttccctcaccctccataactcaaggtgaaagttttcagtaatgacaagtagtaaaatatgagagatttaagcaaattcaactggaaataatgtgaaaaaatattattcgctccggacacatgcttctcttttgatcttccttgtccaagatacattttaaaaaaaatactcctttgataacaagaagtgagcaggggctaaaaggaaaccttatgtctttgttgggaaataattagtctgatcgaatcgcttgctttctgatggacaaaggagtctttaaagaaaatcatttgtgttctctgggccccttcaggcagcacagctttccgaggcttgggcttttagatgagagtttggggaatggaaaatttccctgaataagaaatcagagagcttgacctacacagttacctctctcttaacatgacaacaattggcaattactttttgatccaaagtgtgaggatgaatatggaaaggaagggcgaatcattctccttcttctcaagctcattctctctttagacctgcacctgaagctgattttcttttcttttttttttttttccagtcccagcaattcaatataatctatagctggaaatacctatgttagctgcagctgggggaaaaagcagttggcaaattcatgaatcagggcttcttttctttttcgcttgtgaaaggtaacttccgacagcttaagggtgatttggaatgaagcgtgggttggttcctagtgtcagcacattgcctagttgttccagccaggctggctgtaatgaagcgtggacatccatacatagtttcagtgtcagggacaccggtgactctaatgaagagaggaccttaactttgatgcagaatcatgattgtttatagctgtgtggtgaagaatgggctctgaaatccatcgcacttcggtgaaaatgctgtttggtctgcaatgtgaagctgatagcttaatttctctgatactcagtgtctttacctgtaaaatggtgccaatatcaaagtagctgtctggtatagcagggtttcttaatcttggcattatcaacatttggggccaggacattcttcatggtgaggggctgccctgggcattgtagggtgtttagcagcatcgttagcttctacccactagatgccagtagcactctccccccaccccattatgacaacaaaaatcgtctccagacactgccagtgtcccctgggaggcgcaatccctcctccctcccctcaccgaaagccgctgccatggagctattgtgagaatgaaatgaaataatccatacaatgctctcagcactgtttagtagacagtacatagtaaatgctcaatacgaattagttgttactcagacaccaagagggtaacaacaggcgcacagacactggggcctatttgagggtggaggatgagaggagggagaggagcagaaaaaataactattgggtactaggcttagtacctgggtgatgaaatcacaaaccctagtggcacaagtttacctatagaaccaacctgcacatgtacatctgaatctaaaataaaagtttgaaaaatgaataaataactattacttgttactgtattaataaaactgtcaatagaaactcaacacaatcattttttttctcttgaagaatcttatagaatctctggatctttagtgtcccaatttccctgatattggctaggaaacctcagttgccccacctgccacttgtcaaatgttttgtttttggcaaaaccatccagtgctaggagcaggcaagtcaatttccaagtggttctgtgaatgaagggtgtcctctcactttagtcccagggaaatagctaatgcacctgggtttaatacctaggtgatgagttgataggtgcagcaaaccacacaggcacacttctacctatgtaacaaacatacacatcctgcacatgtaccccagaacttaaaaaaaaagttcagaaaggatcaggaaaggagagatcatatccatagcagtagggacagcaacactgaggatctgagtaattagaagtcaaccaaagcttcctcatcctttggggagaaagcaggatgcccagaagaggtaaccgcagttgctccctggggcctggaggtcttgtgtgcatgctggagtgggaacagggaaaggggcaggtggcgaagagcaacagatgcaatcaactttctccatctatgctttagttctagcgacttctaccacttgatggactgcacctaatagtaaccactgtttgaactctatcatggcctgagttgtgtctcctcaaaattcaaatgttgaagccctatttggagataggaaccttaagaaggcaattaaggtgaggccctaatccaatagagctgatgcccttgtaagaagagaaaggcaccagcactctgtttttctccttatgcagaggaaaggctgtgtgaggatggaacaagaaagcagccatctgcaagccaggaagagtgatctcaccagaagttgaatttgctggcaccttgatcttgaacttctagccaccataactggagaaaacaaatgtctgttgtttaaggcccatcctgtggtattttgctatagagatctgagcagaccaatataagtgcttaccaggtgctcggcgtggtcactcatttcgttctcataatgacactttgaggtaggttttacagaagaggaaacaagctcagaaaggttaaaaacatgtccagcgtccacacaaataggaaatgtactgctgggcctgtccatcttcaaaaaaatgaggtccttaaccaccatctcaatgtgggctgtctctatccccacatcaccatttctagaatgttgacattgtacaagtctctatgtcagggatttaaataaattagctcttgcactttgggagaccaagatgggaggatcacttgagaccaagagtttgagaccagcctttccaatatggtgaaacctcgtctctactaaaaatacaagaattagccaggcatggtgatgcacacctgtagtcccagctactcaggaggctgaggcaggagaattgcttgaacccagaaggcggagggtgcagtgagctgagatctcattgctgcactccagcctgggcaacagagctagattccatctcaacacccccatccccaccccccgaagaaaagtacatcagctcttttaaatctctgggtggggaactcttgctgtgagaaatgagctgatatttggtctttagatatcacagaaacagctactgaattttactgtctacaattttaatccaaccaaggattctgagggtgcatgggggtgagggctcagaaagagaagagcccattcaactccaggtcactccaggtgagttcactccaggtcaagagtcagccaatgctattagtggctgcaatttgcttttcagggatctgcttttatgcaaatgaaagcaagaggtctccaactaaggaaggggaatgaacatccctcctctgccctacaattctagtccaagatgtctttctccagctgggggcttagcaacaaattgtatcttcctccttcgtttccttccaaggacaatgaataatcataattcaaagtagagcaaagagcctgcatttacacagtgcacatttccaatgttttttgagattacctgattttaccttcaagtcatcatgggaggcaagtgctttctgacagatgaagtcaagacatagaagtgaggactcttgacctcaacccactgcatttttcccaggtggtgccatttggctggcagtaatgctgtagccacttggcatccatcacaggtaagggcagcagaattagaggcagacagacctaggtttgaatcctgcctctgacccgaaccatctgtctgacattggacacattaacttatctctttgaaaatggtgtagagaaaatgaagatggagatcataatgatctgcaggggtcaaccccatacaatttgaggggatctatggaaagcacagtgcttggcatatatatgatcaatgcttagcagctgtctttgctgttcccaatggacaagaactttctagaatgtataaggtctgtgcctaagcactttctttcacgatccttgtccatgtcatggggtcctctgaaggaccttagaggtcattcttagtttggctggggcttcccttgggtaggaaagataacgtagttctgaaccaggcagtatttaatgagtgttcactcagttcttggccaactactctaatgaccaagagtccacagaatctgttgtttatgaacgccagccttgaagtcagatcaagtcccagctcagcacctactagcatgtgtcccattggacagttgtgagaattcaatgggataaggcatgtgatatgctcagcacactggcacacagtatgatggagctgacacaatcttcccaccagcccctttctccccatttcctcccagtgcagatggacgtaaggagctctgcaagttggttaagtttcccttttacttctctcattccttcactggaggatggctaaggttgcagtgagctgagatcgcgccactgcactccagcctgggtgaaaaaaagatattgggtttgattaggggctacacaagggagagaatgcagtggtggtgggctgtgcaggaaaacctcaactgcttgcaaacagcatgtagttttagctgggcatgatggctcacgcctgtaatcccagcactctggaaggccaaggtaggtggatcacctgaggtcatgagtttgagaccagcctgacaaacatggtgaaaccctgtctccattaaaaatacaaaaattagccgggtgtgggggcacatgcctgtaatcccagctacttggatagttttcctggaatgacccacgttggttcctgtgctcaatgattcttttccaataaggcaatattcatctcgccttattggaaagggattttccatctagttggaagaatctctcctccgtagctacagccctgatggatagaagcagatttagattttcttttgacttttgaaccatttaatgataactaggcccttagacctccctccccacaaccccgttacagtaatgcccatggcataaacatggaatgtggtgtccaggaaactcggattctaacctcaatttttatttttctaatggggctgaaaggcaaggcaatgtctaaaatttatcgcagtttggatattctgcgtttttgtcattcccttgataaccaacgcagaagtcgatcagtcctaagaactaagatgatgaagcactcacactacatcttatatttcatcctctttcctgtctgcttagcgtaagctctgcttctcatcaggaagatttgtgacaagtagtggtaaattattcccaaagctcgcttgacccacggctaacaacatccttcacagtgggtgttgtgctaaacccctattaacctcattagggaggcaccaggttcaagaggctgaagaagagacccggagccagtaaataagacatggggtagctggctgcggtggctcacgcctgtaatcccagcactttgggaagctgaggcgggtggatcacctgaggtcaggagttcgagaccagcctggacaacgtggtgaaacattgtctctactaaaaatacaaaaattagtccagtgtggtggcgcatgcttataatcccagccactcgggaggctgaggcaggagaatcacttgaacccgggaggtggaggttgcagtgagctgagatcacgccactgcactccagcctgggtgacagagtgagactcagtcttacaaaaaaaaaaaaaaagaaaagaaaagaaaagaaagacatggggtttgattaggggcaacatacatgggagagaatgcggtggtggtgggctgggcaagaaaacctcaactgcttacaaacagcatgtagttttggccgggtgcggtggcttatacctgtaatcccagcactctggaaggccaaggtaggtggatcacctgaggtcaggagtttgagaccagcctgaccaacatggtgaaaccctgtctccataaaaaatacaaaaattagccaggtgtgggggcacatgcctgtaatcctagttacttgggaggctgaggcacgagatttgcttgaacccgagaggcagaggttgcagtgagctgaaatcacaccactgcaatcccgcctgggtgacacagtgagactctatctcaaaacaaaaacaaaaaaacagcatgcagtttatatagcattttcacttagcagcctccccttaatgacctccacctggcaactttcatttaatccaaaacttagagtttcaatcccctgtacaacatatgtttcatgggacaggccaggaactcagatgctcttcatagaccaggaaaaaatctccaggttggccactcctgattccctagctcagaacgcacattcaggtgcatctgccatacagagtcattctaagggtgtgctttagttattgctgtcaggtgcatttaccctacagtggcttatgacatggttaagagcaggcatttgaagtcaaatcccattctggctacttgctagctatgaaactgagacctgttctttcttcaacattcatttattcatttcaaaagctagtacagcgatattcctttggtgccgtggatacagtgatgaacagggcatacactatcccctccctgccttcaaagtgtacaatctactggcaaagacagccctgacaaagtgtgacccaagcgaggatatgggaagacccatttttatgagatcatttgcagaagccactactgtggtctggacagggtagaagtcagggaaggcttcccagtggcgctaagcctaagctgaaaatgaaggctgaataggagatggaggaagggaacctttgctgggcggagagaacctcatatatggaggccagagagctagagacagtggagtgccttaaactctaaataaattgagaaaagttcatctggaagtttctactctgtgtgtgtctgcgtgtagtttccttctttcctttttttttttttttggagacggagtctctcactcttgtcctggctggtgtgcagtggcgcgatctcggcctgctgcaacctccacccctgagttcaagcgattctcctacctcagcctcctgagtagctaggactacaggtgcccaccaccacacccggctaattttttgtatttttagtagagacagggtttcactatgttggccaggctgttctcaaactcctgacctcatgatccacccgcctcggcctcccaaagtggtgggattacaggcgtgagccactgcgcccggctgttttttttgtttttgtttttttaattttttcttttagtggagtgtggggtagagagggaaatggtgagagctgggactggagagcaactggagagctagtgagggccgggttatgaaaggggttcagaaccgtattaaggagaatagacctgtatcctcaaagtaatgggagcctcatagacaattttaaagagggaattacatgattgagtttttattttggaaaaatcaactaaattttggagaatggtttgtgtgggaggagaagaagttggaggatagagcagtgacctaaagcgatggccagaaagaaggcttcttgaaggctgagatcttcgtcagttttgtttctttcagcatcccagtttcttggaacagagattggtacataccagacaatcagtaattgcttgttgagtgaccgtggcctagaccagggcagtggctgtagggataaagggattcatgtggatttgagacctaatttgtgggccaagggaaaataatcagtgatgagtagaagggagttaagaaggattctcagtgttctggcttgagcaactgaagggaaaatggtgacattttctgagatgaaaaatccttaaactctttgagcctcagtttcttcatccataaaatgggaccagtagcccacatctcacaagtatgtaaagggagtagcctagtgcctgatacataaggggtaatcagtgcgtcaatgtgtccttcaggctcagatctcctctatagcatgcaaagttccctctataggttatgaagaaagcccacatggacattttcccagggtctccaggtttgaggttcccagagatggtgtcaggagcagcagcaacagccctacaagtggaaatgcatagccaggaaatgaaataaacaactgagattgctaattggagtttattttctaaaaatgaacagcgattctcagcatggcgcagtcacctgcaaagctggtccttaataagctattctggtcgttgtcaacatgaagaatttgattggacagaggagtagattggtggtgaggctttctgtagctaaggagtagttggggtggtgggaggtgggcaataatttagcagaaaggaagtgagtttgtttttaaactcacaatcctccctggggtacaactacttagggtcatttctccagtctcattttctgggaaactggaattgcacctggttatgggcagccagagcattgttgaggctgcagtttcctgtggacaagatgcaaccactggtgttaacaaggcccaggaggtcactcagagccaccgccacctctttctcttccatctactcagtggatggagaccaagcaacaactctctgccatgcaccacagtatgctagtactgaggttaccgagatgcacgagtcacagcccctgccttttgcaagggaaacagaccagcaaacaggcaatcacaatcccataggatgggagtccgtatttatttcctagggttgccataacaaatcaccacaaacttgcatggtggtgcaagtttaacacaaccacagaaatttcgtatctcatatttctggaggctagcagttcaaaataaaggtgccagcaaggctaggctctctctggtggatctagagattcatcattttttgcctcttcatagtttctggtattgctggttatccctggtggttcttggctggtaaaagcatcactccagggctcgcctctgtcatcacatggaattctccctatgtgtctctgtgtttcttctcttcttgtaaggatggcaatgatattggatttagggtataacctcatcttagctcagttacatttgcaaataccctatttccaatgaaggtcacatttaaagataccagaggctaggacttgaacatattttttaggagtcgggggacacaattcagcccacaacaatgtgagtacaagcgtgcctgatgtcctgtcgaatcagattttaccttgttacaagtgttatgggagcaatccctatgatgtgatctgcagttctctctctcccttttcctttttcctttttttttctttttttattttgcctcccttcctttacttcttgatttttttttttttttttgagatggagttttgctcttgttgcccaggctggagtgcaatggtgcaatctcagctcactgtaacctctgcctcctgggttcaagtgagtctcctgcctcagcctcccgagtagctgggattacaggcgtgcactaccacactcaactaattttttgtgtttttagtagagatggggttttaccatgttggtcaggctggtctcgaactcctgacctcaggtgatccacctgcctcggcctctacattgttgggattacaggcgtgagccaccgcatctggcctacttcttgacttctttcttccctttctgtagttttgtcaactcatactaattggtcatctcctgcatattaggcagagttctagacatcagggatggagtgcagagaccaaacagacacagttcctgtctctgagactcacgagttatgggggaaagagacagcagccaaacagtcacataaatacatgtcaaatgacaaccggaacaattggaaggggatcccttctgaatatgcagggtaacagcttgaactgaccttccaggggaacaattctaaggccgtaaagaccagtctccagccatagactgtgtatttccactctgtaagcatcaacatcttctagtccacaagatacaggaagaggagagatagaaggtcattgatttacttgggtccatgtatttgaaaccctctgcttgagaagtaggagaatagggaatgaggataaccaaaggttaagtcataagcaaaacaacagcaggtgcagccagttctaggcaagactgggcagcatacaggccacatcctcactctgaaataacaacatggaaatttccatttcagcctctgattgaccacaggccaagtctccacttcagcctctgattggtcatgagccatctccactttagcctctgattggttcttgggccaatccttcataggatataaccaactggaggcctctaaagggcgccaagtgggtgttaccaaactcttttagcttaataagaaccctaaacaacattataatgggagcgtttgagctgcttgttcaagcctgctcccactctgtagagtatacttttgcttcaataaatctgtgctttcattgttttgtttttttttgttgttgttgctttgtttgtatgttttgtttgattctttgttcagtgcaccaagaacctggacaactcacagtcaagcatttccatcccgtaacagttggagaataagcctgagtgacgggccttccatttagcaggtgaatctcagctgctacgtaaatcgtcaaagccagaacttggaatgtgaatatagccatgagagtgcctcagcaaggagccattatgaggtactgataaactgaccaccctataaaaaccaagggggccaggaagttataaatggttcagcagcatccagggaagtgggaaacactcacaaacctgagattatctggggggactcttgagcagcgttggggaagtcacaaccagtggtgagaggctacaaaggcaaggagtacgtggtgtttgagggtaaatgataggctggacctggtcagggtggggaaagggatttcctgggaagcgacgcttgtgctctgtttcccaggtccatgaagacaaagctgtcaaaaaataaaaatataaggcttcccatccacacccatgtaatactgtgaacggatctcagagtttggtgtcaaaactcaccaaaacatacacttaaatgggtgccttttatcatatgtaagtgatatctcaataaagtgaattttgaagatgctggtgatagccctctttgtttttgttttgttttgtttgcttgtttttgttatttcaaaagaaggtcttgctctgttatcttggctcactgcagccttgacctccggggctcaagcgatcctcttaccttagcctcccaaatagttggggctatggatgcataccaccatgctcagctaattgctttttaattttttgtagagacaaggtcttgctatgtttcccaggctggtctcatactcctggactcaagcaatcctcccagcttggtttcccaaagtgctgggattacaggcatgagccaccatgcacagcccctctttttttaaattctgggtgtcaaagccatggtagaagcctttctaattttgctcaagagtcattggatcctgtattatataatgtcagagcctggagagaatcccaagacaattgggatcaaacacatcattttatacaggaggtgactgagtttcaggagagacagcaaggtcatagtcacagcagtcagaaggatgcgccatagattggaaaaatccagaaggtgggagatgggtggagtgacatgctcttagacaatctagcccatgtgctgaggtcagagaagttagatttgaggtccttcagctagtcagattttggccctaaatttcctggccatccacttccttctgtccttaacatgttctgtgaacactcagtcactgctacagtcatacacagattgcatttattttcatatctctttgcaaagcttcttctgcacggggtgtcttgatgtgttcgatgatctgggtctatttaggatcagctcagactcggaaaccggggtggggccaacatcacgaaatggaagaaattataagccaggcatcatagtctggagcagaggtcttcaaacattggtatgtatcaaaattaaagtgccaatccctgggatccacatccagagattctgatttactaggccttgggggtgtctgggaatctgcattgataacccacaatgcaggtgattctgatggaggtggttcaaggacgagagtttgagagtccctgtcctctagcaacctctggattaaacatgggagaaaacaaatagacctgggctgttgactgaccaatgaactttcaaggtaacccgcattcaaaatattctgtatttttcaaaggatggtaatggaaaagaaacaatgacaacaaaagcctgtcttgaacacatacttatttgtggcagttttcagaagcgtattattttctagtgatggagggattttttaaaattctgctaagccttcttttgagtcactctcttgagatatatttcacataccatacaattcaaccatttaaagtgtacaattcagtggttccagtatattcagagttgtgtaaccatcatcatcaattttagaacattttctcctccctccccaagtcctactcccattagcagtcactccccatttcctccgaccccctccacccctaggcaaccactaatctactttctgtctctctagatttgcctattctggacatttcatataaatgaaagaaaatgacacaggttctttcgtgagtgggttcttttgcctagcatgttttcaaggttcattcatgctatagcatgtatcatatcactatttcattttgtaagttaccaagtagtattcctgatgatggattttaaaatggaacttctctcttttcacaagttgaacagctatctttcctctagaataacattttcacaagtggaacatctattttccttctagaacaagaggctttgtagcagataggaatgtcagatgcactgcaaagacttaagaatcttattcaaggcccaagtgacctttccagcctcatctccgtcaattttgcacttccttccatgacgttctagccacacaagacacctctggggtctcccctactggcctctggtcaaaatagcatggcttcttgtctgtgcagtgaatgcctcccctaattctgaactcaagcatctccttgcctggacctttctctcatttttgcccttgatcttgattgtaggtcttttcattttgtgcaatgatgggtgaagtcaccactctttagactggtgacttctctaacagaggaactgaattttcttaatttttgtattctcagtgcctaactcgttcttggcaagtatggggtacttggttaatatttgttgaatgagtgaacgaatgaatgaacgagtaaatgaaagctacagaagccagcatatatagaatgaaagtcgtttttccctggaagttttaacatagtcattttaattcctcctgtttgaaatgacttgtttgcaaaagagtaaaaatgacaatttaaagaatattaaactgcataagcatgaaaaacaatctgctaacagtggttatctctggggaagagttaagaagagctggggggtgttttcactttttctttcattagagacttcaaaagaagaaaagtggtgtaaaaatgggtgttgtttttcttttatggtttttggggatttttaaacataaaaattataaaaaagtaaataaacaataagaagcagagaaaaggaatgtctacacattgttggtgggaatgtaaaatagcacagccaccatggaaaacagtatggatgttcctcagaaaattaaaaacagaactactatatgattcatatgaaatttctatctcagtttaagccattgctagtttgggtctctgttacttacagcggaacctaattctaacaaacacaaatgctttagactcggatctgagtaccaggctggctctgggtgacttgtggcaaatcacttatcccttctgtactcagtttcttcatctgttaaaggagaatgaaaaaaacttacatcatgggaccactgtgaagtttaaaaagcacagtgcctggcacagcaaggacatttttatttattatttatttatttattttttgagaaggagtctcgctctgtcgcccaggctggagtgcagtggcatgatcttggctcactgcaagctccgcctcccgggttcacgccattctcctgtctcagcctcccgagtagctgggactacaggtgcccgccaccgcgcccagctaattttttgtatttttagtagagacggggtttcaccatgttacccaggattgtctcgatttcctgacctcgggatccgcccgcctcggcctcccaaagtgctgggattacaggcgtgagccaccgcgcccggccgcaaggacatttaataaatgacagctcttgccattgttattagcaataatgataacagcaataaacagaaaaatgacaaatcaacgtatatgaaggtcccttttatctgtaacagactttgaatccaatttgatttatagcctgtctgcttatgctgggtggcttaacatattgattatttgaaaaccgtgtggcttagccctagaatggaggctcatttaataaactccacttattgggtgattatgcagaaggcagctgcaatgacctccaggacagagaagcctgatgataatagtagctaccatttattgagcccttactatgagctaccacttagtctaacacaatcccatgagaccgtataattcccgcccccccaccccgcccccctcccccggccccgccgccattccacagatgagaaaatgaggcacagatagcttaaatgctttaaatagctagtaagtggcttagtcaagattcagacccaggttttctgaaccaaagttagtgagcttttcattagactagttgctgctcaagctacaaataatatggtgtaaaaaaaaaaaaaagcggggggtggggcgcgggggggtgggcttggcatggtggctcatgcctgtaatctcagcactttgggaggccgaggtgggcggatcacttgaggtcaggaattcgagaccctctggccaacatggtgaaaccctgtctctactaaaaatacaaaaactagccgggcatagtggcaggcacctgtaatcgcagctactcaggaggctgaggcaggagaatcccagtttcaacctgggaggcggaggtagcagtgagccgagatcacaccactgcactccagcctgggcgacagagtgagactccatctcaaaaaaaaaaaaaaaaaaaaaaaaaaaaaaaaaaaaaaaggaggaagaagggagataacaaaagggtattggggctttaaagaagggtcagcagttctccaattttcacatttgacgactcatttaattccccaatgagtcctcaaagtcttggaatgaagtatggtaacctcttgctgcagtcactcatgccagggagttctgtgaaatctggggaggggttacctccagtacccaaggatgctgagcaagggactatcagttgtccctctatatccaatcttccttcttccaaagtaaaatgatttttcatggagcatatattaattgttgcctagaatcaagactatgcttcccatccttgcttgcagcaaagtgtggccatgtgtctaagttttggccaatgagatataagtaggaagtattatgtacaactttgggtttgtttctttaaaaggaatgggtatgctcttctttgcttttccctttctgctggttggattgcagatgtaatggctggggcagctgtcttggcaatgagatggacatggaatttgcagtagaagaaacagacagaaggagctcgggtctatgatgctgtcataaaccataccagctttcaactaccttactagacttttcgtgacagggagaaaaaattttctaagtttaagcgattgctaatttgagtctctgtcacttacagttgaacctaattctaacaaacacagatgctaccctgccattcattaccctatcctccctttcagtggcccccaatttctttttgggggaattctgtcaccaaattagatgccttttaaaattgacacattgtattgtacatatttgtggggtataatttgatattttgatgcatatgtattgtataatgatgaaatcagggtatttagtgtgtcaatcaccttgtgcatttatcatttctttgtggtgaggacaattacaagcctctcttccagctatttggtaatctacaaaataccttacttttaattatccttgcccaactgtgcaaaggaacaccagactcatttctcctatctaatgtaactttgtaccagttgatcaacctcgccctatcatcccctctcgcattccctccccagtctctattaaccattgttctattctttgcttctataatagcgtctctgttttttttttagattccacatatgagtgagatcatatggtatttgttttttcatggctggcttatttcacttaacatgatgttctccagatccatgttgtcaaaaaattacaaaatttcattcttttttatggttcaatagtattaaatagtgtatatatatcagattttctttatccattcatctactgtaggacacttgggtggatttcatatattggttattgtaatagtgctgcaataaatatgggagtgtaggtatcttttcaacatgctaatttcatttcctttggatagatactccatagtaggatggctgaatcatatagtagttctgtttttaattttctgaaggaacatccatactgttttccatagtggctgtactactttacattcccaccaacaatgtgtagacgttcctttttctgtgcatctcaccaacatttgtttttatctgtctttttgataatatctagtctaactggagtgaggtgatatctcactgcagttttgattgccatttccccaattattagtgatgttgagcatcttttcatgtaactgctagtcatttccatgtttcctttggagaaatgtctcataaggtcttctgcccattttaaaataaagttttttgttattgttgttgttgagttgtttaagttccttatgtattctggatattagtgtcagatgtctaatttgcaaatattttctcccattctgtaggttgtttcttcactctgtttattgtttcctttgatgtgctgaagctttttattttgatgtaatcccatctgtctacttttccttttgttgcctgtgcttttgaggtcttattaaaaattatttgcccagcccaatgtcataaagcatttccccgtatgttttcttctggtagtttcataggtttgggttttacatttaggcctttaatccattttgaattcatttttgtatatggtgtgaggaaggggtctagtctcattattttacatgtgaatatccaattttccttgcaacatttgttgaagagatggtctttttcccagtgtgtgttcttggtaactttgctgaaaatcagttggctgtaggcgcacgaatttgtttctgagttctctgttctgtttcattggtctatgcatctgtttttgtgcctgtaacaggctgttttggttactatagctttgtagtgtattttgaagttgagtagtgtgatgtctccagctttgttctttttgctcaggattgctttggctatttgtagtcttttgtggttccatatgaattttaggattgatttttctatgtttgtgaaaaatgtcactgttcttttgatagggattatattaaatctgtagatcactttaggtagtatggtgattttaacaatattaattcttccaatacttggacattgtactttttgtgcaggaatttaagaaaaattgttttaaaaattaaaaaacccaatacttggacatgggatgtctttccatttatttgtgccttaattgattttttcatcaatattttatagtttcagtgtggagatctttcatctccttggttaagtttattcctaggtatcttacatttttgtagctatgatatgtgagtttttttatttctttttcagatagtttgctgttagcatatagaaatgctactaatttttatgtattgattttgtatcttgcaaatttgctgaattcattgatcagctataataattttttggtggagtctttagggttttctgtatataagatcatgttgtctgcaaacaggaacaatttgacttcatgtttttcaatttgcatgatttctatttttttttcttgcctaattgctctggctaggacttctagtactatattgaataggattgatgaaaggaatatctttgtcttgttcctgatcttagataaaaagttttcagcttttcctgttcaatatgttcttagctgtgagtttgtaatatctggcctttatggtgtggaggtacataccttctgtaacaaatgtgttggcagttgttaccataaagaaatgttgaaagttgtcaaatgctctttctgcatctgctgaagtgatcatatggtttctgtctttttgttaatatggcatatcatgtttattaacttgcatatgctgaatcattcttacatccctgggataaatcccacttagtcacagtgaatgatctttttaattttctgttgaatttggtttgataacatcttgttgagaatttttgcatctgtatttaccaaggatactggcctgtagttttcctttttgttcttgtgtctaccttatattgcaaccagggtaatgctagcctcaataggtcctgggcttttttccaatggcagacattttattattgattccatttcctcactcagtattgatctgtttagattttctatttctttataatttaatcttggtaggttgtatgtgtccaggaatttatctatttcttctatgccctcaacttctttgatatatagttgttcataatagcctctatgatcctttgtatttctgtaatattagttgtaatgtctccatttccatctctgattttatttatttggatattttctcttttttttttaagttagtctcactaaggatttgttgattttgattatcttttcaaaaagccaactcttcttttgttaatttttttgagttttcttttgttctccacttcatttatttttgctctgagacttattatttccttccttctaccattttgggtttagttcttagttttttagatcctggaagtgcatggttacattctttattagaaatctaataaggatttattagatagatagatagatatattaggtgtttattgctatgaaattccatctcaggactgcttttgctgtattccaaaagttttggtatgatgtgtttccatttttatttatctcaaataatttttaaattttccttttagtttcttcattgatgtattggttatttaggagcacgttgtttaatttttcacgtatttgtaaggtttccaaggtactcttgttgttgatttctagttttatactatcatggtccaaaatgatacatgatataatctctgtcttcttaaatttgttaagacctgttttgtggtctaacatatgatttattctggagaatgttccatgtgcaattgggaagaatgagtatactgtaactgtttaatggaatattctgtaaatgtctgttaggtccatttggtctatagtgttgtttaagtccaaagtttctttgttgattttctgtctgggtaatctcttcattattaaaactgaggtgtaaagtcccctactattattgtattgcagtctgtctctctttagatctaataatatttgctttacatatttgggtgcttcactgttgggtgcatatatatttatacttgtgatatcatcttgttgaattaatctgtctatcattatataatggccttctttatttctttttattgtttttgacttaaagtctattttatctgataaaagtatagtcactcctgctcacttttggtttctgtttgcattttttctatccctcactttcagtctgtctgtaatgttggggtaggtctcttgcaggcaacatataattagttcttgttttttaaaatctattcagccactgtatatcttttaattgcagcatttaattcatttacattaaagattgttattgataagtaaggacttactcctgccattttgttgataattttctggttgttttatggatcttttgtgcttttatttctctcttgttttcctctgtggtgtggtgattttctgtggcactaagctttgttttctttttctttctcatttgtgtatctactgtaatgtgtttctttgtggttaccatggggctaaaataaagagtcttatagttataataggctattttaagctgataacaacttaattttggtcacataaaaatcctccagagggccaggcacggtggcttacacctgtaattccagcactttgggaggccaatgtgggcagattgagagcagcctgaccaatatggtaaaaccccatctctactaaaaataaaaaaattagctgggcatggtggtgtacacctgtaatcccagctactcaggaggctgaggcaggagaatcacttgaacctgggaggtggatgttgcagtgagccaagattgcaccactgtactctgtcctgggtgacagagtgagaccctgtctccaaaaaaaaaaaagaatcctccagacttcatacacccacacacacacacacacacacacacacacacacacacacacacaatttgtatgttgttagccttaatgtacatgttggtcttttgtgtgttccttagccactaattgtagttgttcacgtttttgacctttttgactttaaaccatcatactagaggatttaaagatttacacagcaccattacagcattggggtattctgagtatgagtatgggtttacctatactggtgagttttatactttcatatgttttcataatagtaattatcatccttttgtttccaattgtagtactctcttaagcattttttttgtaacacctgtctatttgtgatgaattctctcagtttttgcttatctgggaaggtctctacttctcatttatttctaaaggagagctttgcaggatatacttcacttaatggtgtctcataagtcttgtaggcttcttcattctttttaacttttttttctctgactgggttatttctaaacacctgtcttcaagtttagaaattctttcttctgcttgatctagtgtgttgttgaagccttcagttatttttatttcattcattgaattcttcagttccaagatttttttcctctatttttattgatacacaatatttacatatttatagggtatgtgtggtattttgataattgaatacagtgtgtaataaccaattcaggatatttaatatacccattaccttaaacatttattatttctttgtattgggaacatttcaaattcttcagctccaagattctgttccctctttttttatcgattaataccatttgtaaatatttacgggatatgcagtattttgataaattcatacaatgtgtagtgatcaattcaaggtatttaggatatccatcaccttaaacacttcttatctctttgtgttggggacatttcaaatcttctagctacttttaaatatataatatatatacaatattttgaatatacaatatattgttaactatagtcactctactgttctatcaaacactagaacttatttcttctatgtaactgtatttttgtacccattaaccaacctttcttcacctacctcccaccctttctggcctctggtaactatcattctactctctccctccacaaaattaacatttcaagctctcacatatagtgagaaaatgtgatatttgtttttctgtacctagcttaattcacttaacataatgaccattggtttcatccatgttgctgtaaataatagaatttcattctttttatggctgaatagtattccattgtgtatacataccacattttctttacctaatcatccattgttcaacactttggttgattccatatcttgactattataaatggtgctgcaataaacatgagggtggaggtaaccctttgatatactgattttcttttatttggataaatacccagtagtgggactgctggatcaaatggtagttctattcattttttgagaaacatccatacagttttccataatgaatatgttaatttacattctcacccacagagtaaatttccttttctctgtctctgtaccagcatttgttgtctttttttgtctttttgataaaagcaatactaactggggtaagatgatacctcactgtggttttgatttgcatttccctgatgattagtgatgctgaacattttttcctatacccattggccatttgtatgtcttcttttaggaaatgtctattcagatctttttgctcatttttaaatgggattatttgtttcagctccaagatttctgtttcgttctttcttttttgagacagggtctcactttgttgcccaggcttgaatgcagtggtgcaatcatggctcactgcaacctcaatctttagggctcaagcgatcctcccacctcagcatcctgagtagctgggactacaggtgtgcatcactacacccaattaattaaaattttttttaatagagatattgtttcactctgttgcccaatttggtcttgaactcctgaccacatgtggtcctcctgcctcagcctctcaatgtgttgggattacaggcataagccactgcacccagccctggttcttttaaaacatctatttctttgttaaattcctcattcagatcataatttttttgttttattgaattatttgtattatttggtatattcttgaatttctttaagattattattttgaattccttttcaggcatttcataaatatccttttctttggcgtctgttactggaggcttattgtttctttgagggtgtcacgtttatttcctttttcttgtgtccctatgttgatatctacacactttgtggaacagttacttttttcaattttatggaataacttttatagaatgaggcttttccctgtagaagggccctagggtatcagttgggaatggtgcactggttttggttctaagtggactgagtcatatgatctccatacagattatttagctataatctttgtctgcaatgtctgcaattgtgtcaggggccttggctatgggagtttgtgacaatggtaacataatgtttctggggcctagggcatagaggtggttgtcgggccaggtatctgcaggtgtggtgggttgacaggctgtgtagtgggctctcttggagagtgggcctaccactgggctggctctcagggtaggtatgggtgtagcatgccaggtggctgtgtggggctttctttgtgcgatgggaccacctctgagccagctcttggtctgggagtaggctggctgactgggcagggcagtagccccaatttctattagtggtttcatgcagttctagaaagtcttcacagggtggagcatatgacctaggataaaccaatcataacattttattccctctgctacagtgagtgtttctgggacaggtttgtgacctaagcttgcccagtcagaaggaatcttaggatacttgcagagattgctgagtcaaagacatgctcttttgctatggaaagtatagcatgtgcatgtgaaacttggaactgtgaatatcatcttgctgtgatgaaggaaacctggctgagaatgaagctgacataaggaagtaaaaaaaaaaaggtacaatgatagacaaacagaacgagagtcttgatcaaattatgcctaaaatctgttaccttctgtgttcttcatatttgtgaaccaatatgttgcctatattgtttgctattactttttggcccttatattctaagtcaggtttgggatggattttcttatttgcagccaattatatcctaattgatagagatgtcctgatgtgttttggttctgtgtccccacgaaaatctcatctccaattgtagtccccatgtgtcaaagtggggaggtgattggattatgggtacggtttcccacatgttgttcttgtgatagtgagtgctcacgagatcatctgatggtttaaaagtgtggcacttccctcttcactctcttcctcctgccactatgtaagacatgccttgtttccccttcatcttccgccataattgaaagtttcctgaggcctctccacaccatgaggaactgtgagtcaattaaacctcttttctttataaattacccagtctcagatagttctttatagcagtgtggaaatgaactaatacatgtcccttcaccttctaccacatatagaaccaacaacaacaaaaagaggaaagtactttgttagctcttctgaaggaagatagagttacagattgaatcagagatatttcctctgtgatccttccctgatgtccccagttctgggcaaagagccctccttgatattcccatagctccttttcattctcatctcttataggaaagggagtctttagcataatacatcattgcaattatgctatgagagccaatcagtatcagcaagaagtttgcttatctagtgtctagttcattctgatgaagttaagagaattaccaagaagaaaggtatctgccatttttctttcaggatgaaggcaggaataacaaaaccatgcttttgaccatgtagggagctgaaaggatggagtcaaggccttgaggagacagcagagaggcaactaagagaagatggcaggcagccagaagaaggcacaatcccaggtacccatttgagggaatccaatgggggaaagtaaagaaacctggacgttttaagtgtggtgatcagattatgctctttctggctaaggactaggacaaggccatccaagtgcagaacaaaatggtgggtttgcatttgtttgctgtcaatctcccctgtcaggtcaactccacgaggacaaggatgataatggcttggccaccattatctccccacagcacagcacaatgcctgggacatgaaagatacgttacaaatatatgtgggatggatggatggatggttggttggtaactctcagtttatatctttgggctgagtattatagttaagaacacagtttcccagagtgactcagttaaagttgagcttcttttatgcaaactctccttctctgtctttcactgaatttcactgacagaccatgaaaactcagaacagaaagggataatgtcgaggcgaatcgtataatgtcaaggcaaatcctgtctcccatctagaggccagggaaggaaattaatcactttgctaaagtctggaattctagttcctctgtctgatggttgatttaaggtcaacctctgcttgacttaaggtcaacctctgcttgacttaaggtcatggtgtattattttttaacatcattatgggctacactcatgaaaatgcctaaacataagagaaagatgacaccttgttctcttgctccacatgtacatatatctgacctctattcaacattcatttaaactgtgattcaatgagcatctactatgtgccatgcactggactcagccttggggacagaatgaagaataagacacagcctctattcttacctagtttataatctagtgggggatgacaagccagtgatgataatacagcacaagatgcagagaggcagaggttgcagtagggacccacataggaacattgaagtcagctggtgggattgaggagcacttcctggaagaagttttgcttaagctaagcacatggaaaagcaccagccaggtgaaacggttacaaaggagaggaatgtttcaggaggaaaatgggagtggtgattggagggtgatggcaccagagtgaaaagctggggtcaagcattttagggccttctaggtcatgcttagcatttcagacatcctaagagcagtgtgtgctggagtcactgggaagttttaatatgggaataatatagggatataggatatagggatataggaataatatagaaagttttaatatgggaatttaatataggaagtttaatatgggattaataatatagatataacctatagaaacttcctctggggcagtgtggaagggagattggagggggtcaaggttggaaatgaggacaccagtttggtggctattttaacataagcacatgcactcactagggcccaagcatatgtactcactctcttgctctctctccctccctccctctctccctccctccctccctctctccctctctctccctctctccctctctccctctctctgcctctttccttctctctccctctctccctctctctccctctctcttcctctctccctctctctccctctccctctctccttctgtctctctttctctctcacacacacacactcatacacacacacacacacacacacacacacacacacacaccaaagatatatgcaagcagcaccaaagtatgcccaccactggggctggaaaacaatgtcttaggctgctccatttcctaatgccttaattttctcatctgtagaatgggaacagctgcaactgtccctcggtgtctcccaggattgctcagagagtggaaatgtcatgtggtgaaagcctttacagctcagtgtggataagtgcaaagggctgtttattcctggtcccttttcatttcatccagtccttcaatccccagcatctgaagcatctctgggaactgcatatggaataagacattctggatgacagcagatcttaagaaagtcaggtttagattagatttccactcaatctcaaagttgaaattagagtaggggaattgaggtcttacctctagacactataactgagaaattacaaaattggctggagactcccaggcaagggtaggaagccctctggcttgggactcttttgaagggatgattccactgattggacagtgttcacactcttggctgtggagtacctgtgtgagtctcctagggcttcttaacaaattgacacagactgggtagctgaaacaacaaaaatgtatttctcattctggaggcgtctctctgtgacgtctgagatcaaggtagtagcaggatcggttccttctgaggctgccctacttagctgtcatctcgctgtgttctcacatggtgttccctctgagtacatctgtgtcctaagttcctcttattataaggacactagtcatagtgtccaccctagtgacctcatttttacttatttacctctttaaagaactcatctcaaatacagtcacatgtgaggtgctaggggaattttggcagaagtgggaaacaaaattcagcccacagtaattcccaaatcgtctatttgggtagtggatataaacaaacagtgaggaaatcccaagactgtacaaatttctgctgaagtttatcctccaacgaagggtcctcaattgaatagatttgctgtcatctcagttgtggcagcatccatattttcctgttctttatctcagctctgaggtgctgctgcagaaaggtgctggtctacattcagttctctctttctttaccactttgcagaacaagttttgctatggcaaccactggctgggaagagataacccagggggtgcgagggtcagctcatgttcttctctcctcatttctaggacagctctgttgtgcttcagctgctgtgtaaatccccaaagaggagttttttgctaataattgtgtgtgtgtgtgtgtgtatgtgtgtgtgcgtacctgcatgcatgcatgtgcatgtacgtgcacacgtgtgtgtgtgtgtgtgcgtgtgtctgggcaaagtggtaccttcaagaaagtagccaaatggaagataggatcaccctgaagagggaagccattcactcattgaccaatgggtcacacttggattttctgtctcaggccaacccacattctagtgactgtgcagcccttggcagttttcaactggctcctcctgcctacccagcagatgggaataatactctgcagacttcaaatcctcttgattctctctcctccaggttttgaaggcagattttatctattgtgcctcttgggctttggtgtctgggccattcacagctacccacctagagacccctcagatgtgtcagaagtggaagtttgtcatgggaagaggaggcagtaatgtgaaagcaatgtgaatttttgctattcgaaggggcacatgactcactgagtcatctgcctgaaagccatcttcagtgtcccctgggccttgaagacgtgggaggcagtgtttgtggatgagaaaggggacattcggagcagagatctgttcaagtctcctggcacaactcaggtcctccaccttggagtctgtcttgggtggtcccaagcatcataaatcctctggaatctgccctgaacacctggatttcctgctagggtcttcagtttgcccagtgatgtgtccatggccagctttgtgcaaagtttgctttccagctcagttgctctgctgcagtttaccaaacttgctagtggacagacacagccttgagcagtccctgtggcttctcggggcatctgtcaaagatgtgcacacagaattcaacaaagttccggttcctcccttgggaggataataattttgtgtgtttgtatatgtgcatgcatatgtgtgtgtgtgcatgcgtgcattcatgcatgcatgtgcatgtgtgtgtgtgtgtgtgtgtgtgtgtgtgcgcgtgtgtggctgggcaaagtgataccttcaggaaagtagccaaatggaagataggatcaccctgaagagaagcctttcattcattgaccttatcctcaggaagccagacgtggtacccacagaggccaatttagatctccggctgtttctctacttccctgttggccctatttgtatatttctagcatgccttttctttatttgttcattcactcattccttcattccacaaatacctattgagcaccagtgatgtgctaagtatggcttaaatttaccctgggaacacagaagtgaaatatacaaatctcctgcccttgggtgcttatattttagtgtgagagggtgggtgagtggatggagggaggtaggtctttgcacttgcgttttcatggattataacaaattttcacagcacttttaattccatgataatctctaactggaaaagcaatcccctcaatacacacctcccaccactttatcctgaatctctgtcctggattgtgaagggatgtcaggcatggcaatatgcttttatgcattttccttttgcttaactcagggctttttaacccattctgtgctctggactcctttggtggtcctatggacccctcctcagaatactctttttaaatgaataacaaaatatgtaaggttatgaagaaaaccaatattttgaaatgcagttctgaaaatctttttaaaagttgtggtattataacttttgtgcccttttattaacacattaaagaacatgatttagcagtgggtttcataacaactgtgatttcaaagtactgatgagcataaatgatattttgaaatatctgtaacacctgcaacgtgttatgaaaatatccctgatttctattggtgacaaagtcctaggtactgcaaatagtaatgtggtttgttgtcactgtataaatctgctaggtctgccattacaaagtcccacaaactgggggacttaaacagcagaaatgtactggtgtgtgtgtgtgtgtcttggcaaagtgataccttcaagaaagcagccagatggaagataggattacatttcaacagaaatgtaagacagtacatttctgtggtttaagcctcccagtttgtgagactagcccaactctgttactagggtcttgcttttaacctaaaggatgtttcctcaattgtattcaagtacaaacagaaaggtactttgagttctggaggctcaaaatccaagatcaaagtgttggcagggctatgttcccactgtaggcactagaaaatggccaagataatacaacaatctacacatacacctcacacataagaaagagaggtaggcattgtgtttttgagaaacaaaaggctccaactagcccaactctggcactagaggcttacttttttcttgatagcctactacatacctccctcactctcagttctctgacaaacaactatagcaacctcaagtgacccaatcttctaacactgaaatcacctaaggatattatgcaactctaggaatacatggtgaagggaaactacctccatttttaatctaaaagccaaatgtcattatgtcaccccctggcactacaccttgaccttctcattggtttcaaaaatccttaaggtagctttcaaggttccttatgactggtccttgcccacctccctggcctcatcccactcctcattaagccccaagatggtccagccacctgccttctcacaggccattgagcacacccatcttctttctgcctctggctttagcacgtgccatttgttctgctgtggttcagaagctttaaggttttctgaaagatgtcaggatgatatggttttgctgtgtcctcgcccaaatctcatcttgaattgtagtttccataatccccacatgtcatgggagggacccagtgggaggtaattcaatcatgaaagcgggtttgtcccatgctgttcttgtgatagtgaataagtctcatgagatctgatggttttataaagagcagttctccttcacacaggctcttgcctgctgccatgtaagatgtgcctttgctcctccttcaccttctgccatgattgtgaggcctccccagtcatgtggaattgtgaatccattaaacctctttttctttataaattaccctgtcttaagtatttcttcgtagcatatgaaaatggactaacacacaagggaatgcacttttctggcctctgaattagcaaagggaaagacggtgtaaaacccaagagtttacagtcctgaggaatgcactttgcatatgagtgagagtccagttcatctaaagcattccatttttgaatggagctatcagttcctgggcttaaaacttaagttctgatttacgtctctgtatgtgtttgtgtgttttgtatgtggtttttggtgaaaataatttcttacaggcttggaataatgagctccctgaatgtgcaagctttggaaatagtaatctacctgtgctaggtaaactgtgtctgaaatgttacctgttgagacaaaaatattcctgggaggtgtgattggatgtgttctgtgtgtgcaaggggtggtgtgtgtgtgtgagtgtgtgtgtgtgtctgtgtatgtgtgtatgtgggggggggggcagtgaggaagagagagggagagaccttagcccaaaggagtgtttcctgaattgtattcatttgttcactgcctttaagatttttgctatattcaactaccatctgtacttactttcttacagggatacattttcatgttttctttaaattgacccattttttgtaaacgtagcttcaacctgaaaagactatccaacaagccacagacttggaggcaataattgaaaacacacatctaagaaaggtctggtatctaaaatatatacaaagaactcttaaaatccagttataagaaaacaaagaacccaaattaaaaataggaaaaatacctgaacagacacctcaccaaagatatacagatggcaaattagcatatgaaaagatactcaacatcatatatcattggagaattgcaaattacaataacagtgagataccacgtcacacctattagaatggctataatccaaaacatggacaatgccaaatgccgaagagaatttggagcaacaggaactctcatttactgctggtgggagtgcaaaatggtacagccactttgcaagacagtttgacactttcttacaaaactaacatactcttaccatatgattcagcaatctcactccttggtatttacccacgtgagttgaaaagttatgtccaaacaaaaacctgcatataaatgtttatagcagctttattcataactgccaaaacttggtgctatgatataaatgttttttatccccgaaatttcatatgttgaaatcctagttccccaaagtgaaaggggtggagctttggggaggtgactagatcatgagggcggagccctcatgagtgggattagtgctcttatagaaaggcccaagggagcttgtttgtcccttacaccaagtgaggatgcagccagaaggtgctgtctttgaggaatgggcacttatcagacactgaagccagtgctttgatcttgcacctcccagtctctacaactgtgggaaatcaatatttgttgcttataagccacccagtttatggtatttttgttatagcagccaaagcagactaagatacttggaacaaaccaagatgtccccttcagtaataggtgaatgcatgcctatggtacacccagacaatggaatattatccagcaataaaagaaatgagctaacaagctgtgaaaagacatggaggaatcataaatgcatattgataggtgaaagaagccaatctgaaaaaggtatgtctagtatgattccggctatagcacattctggaaaaggcaaaactatgggggcaggtaaaagattagtggttgctgggcgtgggtggatggagggatgagtaggtggagcacagaggatgtttcgggcagtgaaactgctctatataatactgtaatggtagatacatgtcgtcaacatttgtcaaaattcttagaatgtacaacaccaagagcgaaccgagatgtaaactattcactttagttaatacgaatgtgtccatattggctcattgattataacgattactactacactaacaattagtactacactaatgcaaaatataaataataggggaaactatgaggggaagcagaagaggatatatgggaattctttgttctttccagtttttctgtaaaataaaattgctcggaaaaaaaaatctgttattaaaaaagaatatcatatccaaggaatcacatggttgatgttctcctagttatatgttttcctgcatatgaatacatatacaactgttagaagaaatacaaagtaatgaaaatgtgccacccaaaatcatcttaccagtagaacttgaaccacatactttaaaaaaccacagttccatccctattttttaaaagtagtggtcccttcctcatctccctgcttcccctaaataaaatctcagcagacagacaggctagagcagagctgcttgggctaagatggggagaggcggcctggcgttctgcagccccctctctttccaccttattttccatgaccccctccctttaaccctgacaacaccacagaaccctgctgctatcaggaacacagctgagaaaccactggtctaaaggtcagcatatttggtagagcacaggatgccctgattcccatccaaagacccctggcaactgtagggaatcctctaagctcccctctgccttggttgtctcctgtaactggagcccccctggatctatcttgcaaaggtgtgatgaagacagagactaagacagatccatgtgtccttggaagagtcttggaacacagttattccaggctgaaaggatgcaagtttaaccctttaatacatactgcttgctgatgggagtagcaattggtgtgaccactgcagagagcaatttggcactatggggtcaaattgaagaaggaactgaccctttgacctgccaatgccacttgcaagtacatgtccaagtgtgagttcagaagctcttaaacatgttcatgaggaatatggtcaaaggctgttattgcagtagcatttgtaaatgtgaaaaactggaaacaacctgaatgtctatcaggaggagaatggataatggcattattgtagactcacacagtggtatgctagacagctgttaaaataaactagatgtgtgtcagcatggaaggatcttgaaacataatgttggttgaaaaaaatcaagttccaaaatgatatgtatgacatgattctgtccttatcaatactaaatatactaaataaactgaatatagtttatagatatatatataggtaatagattataaagacattagaaaaatatgtattcatgataataggcagggaaggggttctggggaggaggaacacaaattgggtggctttacacacacatacatacacacccaagcacactcttacacaaatctgataaaattctaacttttctcaactttggtaaatacatatttatttaaacatagttgtttttacttcctacatttaaattaagacattattttcatttggctacaatctatcaaacagttctgtagctcttactaggtatcagattttacaaccttcctaataaccccaggaggtactgttttagaagggaggaaactgaggcacagagaggctaagccactcatccaaggtaaaacagctggtaagagcagagccgggcatcagacccaggtagcctgacacacagtccatcttctcaagcacgtgccacaaggtatccgtggcttgtaatctctcacttgggttccttacatgtaccctgtggcccctcttacactacccattgtctactttgtattaagcgttgtaggagctaagttcacttctccctcttcgtactcctccagctctagcctggctcctgggccatagtaagtcaatagcaactgctgttgaacaacggaatggatgcatgcatgagtggcttcaggttcctggaagctgctctgtgccagtatcatgctcagggtcatcatctctgagtcatctgctgccatctgatgttacccaggatgttggcactaggtatatggaaaatcagcccaactggtagaaaaaaaactcaaataatgtgggatgtttatttcagaagcactacctttctccctctacactggagtagttggtcagggaaaatggtaatttatattttagaaaatatccaggcctccttgcaaatccattttctttctcccactaattcacagtgaacttctggtttcaatttaaatgacaattctgagcaaccttctcttgccactttgccccttccctgctgctattctgcctcgtattaccccttttccatacaggaatttttttttttttttttttttttttttaaacagagtcttgttctgtcgcccaggctggagtgcagtggtgccatctcggctcactgaaacctccacctcccgagttcaagcaattctgcctcagcctcccaagtagctgggatttcaggcgcctaccaccatgcccggctaatttttaaaacacttttagtagagacagggtttcactatgttggccaggctagtctcaaactcctgacctcaagtgatcctcccgcctctgcatcccaaagtgctgggattacaggcatgagatattaaacgtatcacaacttataatcatgtatttatcggtgaattcactctttctaatgtctgtctgttggagagtcaactccaagagtccaatcaagcatcatgcatgtttggctcataatttattgccagtgcctggcacagagtaagtgttcatttatcaccatggaatgaatcttgctgcttaatgcagtggcttgactgaaagacattctacagaggcttccttcttttatttaacagcaagactccttttattaaatgaaatggtccagactcccttatataaaccaacacatggctccggttacactggggaggacgtgtgattggggaggatctgcttggcctgacttctccctgcttttcccaagaagcttccagaggcatctcccagcccaccccttggcaaacttttctgagccctgatcttgagaaaaccagaagggtcttttcacccaggaagcccttctttgtgggttgaaagactgatggtgtgtgctctcctcccaggtccctgattcagccttgtagggcacttgtctaatgaaaccataaattctcccctaaatgagcattctgatttggtttgctcttcatatgaccttttcctggggaaaatgtgaagctttccctgagttatggcaaagactccagtgggtggctgtgtttgtcctgcctctgccatctgatagtctaattcatttccaatttatgagcttgttagttccccagccagttcccaccttggtgctgctgacccggtggcagtatttgcctgtgtcatcttgctcagacaaacacagacgtttccgctgaggaggcagtcccagctctgtcatctctttgactgaccctggctgactccgttgaaagcatcgaaatcatagagcaggctcccttcccatagtcagtgaacctctccgtgtcggcttcagcatggctcagaagccgagtttccctgtgtttactaaatgcttccctgccaaaaagacttggaataacgtctgcctttcaaagtgatggggctgctgcctacactcggtcccttcttcctgctgggattttggacttccctaagttctccatctggaatgctcactggcagattctgtggcaggataggggcaatccccttgctttgaatctgactctgggagtggcaagaagtggaattggaggtgctttctatgtgcctctattgtctggcctctgcaacgggcacaataaagtaccccatagaattctgggagggttaaataaggtgcatacaccaaaggatttaggagtagggtattgtgaggactttacgtacctttatattttatttttatttttttgaaagaggatctgtctcccaggctggaatgcagtggcttgatcatgactcactgcagcctcgaacttttgggctgaagcaatcctgcctcactttttaccaccacgcctggctattttaaaaataaatttttgtagagatggagttttgcccaggctggccttgaactcctggcctcaagcgatcctcctgcctcgacctcccaaagtgccggaattgtaggcatgagccaccgtgcccagactttaagtactttttaagcgattcagtctatgtttatctctatctatgtctacatgtacatctatccctatatttaaatctatattagtttgctttggctaccgaaacaaattaccataaagtcggtggcttaaagcagcagaaatttattcttttcacagtgctggaggccagaagtctgaaagcaggtgtcagtagggctgcattccatctggaggcttgaggggagaatctttccttgctgcttccacttctgatggctattggtgttcctagtcttccttggctagtggccacatcattctaatttctgcctctgtctgcacataccctcttcttctgtgtgtctctcctctgtgtctcttatgaggacacttgtcattggatttagagtctgcccagataatccaggatgatctcctcaccttaagattcttagctcaattaaatctgcaaagatggctaggtgtggtgactcacgcctgtaagccctgcactttggaaggccaaggtgggtggattatgaggtcagaagatcaagaccatcctggccaacatggggaaatcctgcctctacttcaaatacaaaaattagctgggagtggtggcgtgcgcctgtagtcctagctactcagtcctagctacttcaggaggctgaagcaagagaatagcttgaaactgggaggtggaggttgcagtgagccgagatcacaccattgcactccagcttgggcaacagagcaagactccatctcaagaaaaaaaaaaaatctgcaaagatctcttttccaaataaggtgacattcattcacatgttccagggatttgatgtgcacatgtatataaattggccacaaccgtgtctctgctatccatctatacctatatattgatggaaaagcaaaaatattaagatgctaaccatttctgaatctaagttttccatgtgtgtgtgtatatatatacagacatttgttctgcctttgcttatctgtattctcaagttcttctataataaatgtggtgttcttaaataaccagaccactttaaagataatgatgtgaagctgtcagggctttgtgagaagcgtgaagatagttcctgcttttcacagctccccaaccaagagccacacaccctcaaagatgctccagagactctaaaaggctgtagcttgtgtcccaaggaataattgcttttattacagctgtgtaataaggaattgtgcacccacacaactccttatccaaaaatcctgggaatcaaatatgcttttgaattcagatgtttctagattttagaaaaacattcaggcgcatgtactatttattacatcacacacttagtgggggtctgggtggcatcccataatcaaacatattatgtctgctatgatatgtttggatatttatactaagtggagtaaataaaaatctaaataattccacacttaatttggtcagattttgccacccaatgagttttagcaccaaacatatgaaaaacatctggatttcagagatctgtggattttagaattattgagaagaaagcgaaggctgtactagtcttactgctttttttatatgtttgaaaatcttcataataaaacatttaaaaatgaggttgtgcttagtgtcatgtctggcactgaataagatctcaaaaaaatgtgtaaccattaacattaactttgtaatcattaacttattgacagtgttgtaagtcagacagggattactgaagattttgacacagaggaatgacatggtcaggacaagaagaatctagaaggatccctatagctgtggcacccaagatggcttgcatggtgcaagcagtgaagagaggtggttaggaggctctgggactcacccaggcatagggtgataagatcctgagtagaagaggagaagaaagggccaggcatggtggctcatgcctgtaatcccagcactttgggagcctgaggcgggtggatcatgaggtcaagagatcgagaccatcctggccagcatggtgaaaccctgtctctactaaaaatacaaaaattagctgggcatggtggtgtgtgcctgtactcctagctacttgggaggctaaggcaggagaatcacttgaacccgggaggcagaggttgcagtgagctgagatggtgccactgcacccagcctggtgacacagcgagactctgtctcaaaaaaaaaaaaaaaaaaaaaaaaaaagaggagaggaaagagtgaatgaacctggaagaacttggtgagtgttctaggagaacaggatggattcttgtcaccccaatatgcttctgaatgacagcaagagagacatactgaatgtttggtgcatttaggaaggaaaatacatgagtcaattcaggaacaagtcagttggaaatttcatcggcctcctaatctggatagtggcctttgtaagagcagcacttttagttgtaagggttgatttggggcggtgggcttggtaatgaggaccacctgagcatgaagcatagtagcctagtggggcccctctgtagaggcagttttatcccaggttactgatttcaaagctgcagatgctgtgcagatcacaggggctaaggtagggtttctcagccctgattgtgcattgaatcacttggagaaagagcttaaaacactctccactgtagatcaaatagaatagaatctctgggcctaagaccctggcattatgtttgagaagctcttccagatgattctaagatgcagcaagatggagactgctaagtttagggttcagaaggggcaggggaaatgacaaaaaatgcagtcaccctgagctctccctattaatatgcaaaggggaagggtctgggaaatgatttgagtagtgacagagagggaggaagagaagaataacccaaattgggtgaaaacgtaaaaaaccaggagattaaaaaaaaaaaaaaaaaagcaaaaaagcaacactagagatgaactgcgtagtaagcgtgatggactatcccaaagccatcaccatcaccatcgcctaaggggcgatggaagacagagcacaggaaaagatcaaaacaaagcaagatagtccatggaggaattgcaacatttcctcactaaacattgagcgtggggttaagaggttagaaatacagcaaagggaggaaaatgcacagccctaatagagcagttattccttaggatccacactgcagccttttacaaagtccctggagcatttttgagggtgtgtggctcttgggtggggagctgtgaaaagcaagatctatcttcacacttcacatgaagctttggcagcttcacatcactatctttaaagtggtctgggttatttaagaacaccatatttattatagaagaacttgagaaaggcagatgagcaaaagcagaacaagaccaaagctaaattcaacagtcctatgtaaaaccaccaccaaagccagatctatttctttcccattgtcttgtctatttctttcccattatctttcctctgctctgagtgtactttttcttttttcttttcttcttttttttttgaggtgggtttgctttgtcacccaggctggagtgcagtggtgcaatcagggctagccacagccttgacctcctaggctcaagcaatcctcccacctcagcctcccaagtagctgggactacaggagcaagccaccatgcccagcttatttttgtatttttttttttttggtagagatgggggtcttgctatgttgcccaggctggtctcaactcctgggctaaagttatctgcatccctcagcctcccaaagtgtgggattgcaggcgtgagctactgttcctggaatactttttcttcttacacaaaaagattatactagatctaatctgagggaacaggatggattcttttcacccctaatatgcttctgaatgacagcaaaagagagacatactatacaaaatgctgtgtgcatttaggaaggttttgtaattttttttcatttagcaatagattaggaacattttcatttaacgataaattgggaccatttttttctatgttagaaaaaaccacatgatccttttaaatgactgcctaatgttttattgtatgaatatttcggcatgacttaattcccttgtaataaacacatagacaattttcagtttttcagttattttcattgctctaatatcctcatacatgtatctttatgcagttagctgatttttgctttgggaaacattgctccaagtggaacggctgcaacaaaaggtgtgtacatttttaggtctattgattcatagcaccaaactaccctgtgattagccctccccgtggtgtaatgtgagtgtgtgaggaattactcttaaactagtcaatgcagctttatctatatagataaataaggatcatgctgctctagggttctctccacttgatgggatgaagtctaattctctgctataaggtgctgatttacctgggacaaaggtgttcaaacccatcttctctcctatatctccataccccacgtttgtaccctcatgatgtgaacagggtggggtaaaagagattgggaagctctcccagccttctcgggtcctaagtgcctgctagtccttcaaaaaggcaaggaagacaccccctccagttacccagctttagaaacaataaacctctgtggccaggtgcggtggctcaggcctgtaatctcagcactttgggaggctgagacgggtggatgacctgaggtcaggagtttgagagcagcctgaccaacatagtgaaaccctgcctctactaaaaacacaaaaattagccgggcatggtgacatgcacctgtaatcccagctacttgggaggctgaggcaggagaattgcttgaacctgggaggtagaggttgcagtgagccaagatcgtgccattgcactccagcctgggtgacagagcaagactgtcaaaaaaaaacaaataaataaaaaaggaaaagaaagaaaggaaagaaggaaggaaggatggaaggaaggaaaagaaagaaagaaagagaaaccaaacctcctgtgattgaagctcaggagcccccatcattttacaatgactgctttgggcgatttttggtacctaaagatagagtcctgagggtggtggttctcacccctaactgcaaattagaatcacttggaagagattttaatatattctgatgctgaggtcttactccagttcatttaagttagaatccctgctattaggtaggggacttggagttttaaagtgatttccaggtggttgtaattgcccccaaggttgggcaggacagcctcagggcattaaatgacccttgttagagaagatgcaacctggggccttagggaaagccaaaccctttcacacattttcaatgagctctttaacaaccaatttcagactactttaagcattttaaactcttcctgccctcaggcacatagtccaagcagcacattcataaagggagaggctattgcctcagctcaaagaaaaattacacttctttcatgtgaatataccattctgccaatgggcagtttaagtcatcacttccagacaatttgttttataattacaaacctcataaaaataatgtcctacaaattaatcagctgaggaaggactgaaaagcttttgttttgttttgggtggttgttttggctagggacaaactggctcttttaaaaaaggaaaatttccagagtcttgcaaagtccctcagctcactgaatttcatgtcctctggcccttggattttaccatccaactcaggatactcacagtcttcttaataaaccctcactctcctgtcctctaagctgttgctcacatggtggtttttccacttggtgtttccttgaagtaggattgccagatttagcaaaaacaacaacagcacaaaacacagagtgcccagttcaatttgaatttcatataaataacaaataatttttaagagattctgccacttgttaaatgtgtctgttctaagatgcctcctggaaccagggaactaaccacaggatggatttggggacccactgtactcactgtgagatggatctgagctaaaacgccattgcttgactgacctccataagctcttcctctgactagtggaccacagtgatgtttggggttcccaggaattggtgtcaattcagagccagtgtccagtaatcactcaaagttctgattatttcctttttcctaatgcatagtcaccctgataagaaccccttggtccctttggggaaggctgaagaaagattagcaatatacactttgggcagtatagcatggtccttcctcaaggggactcagcctccctttcattcaaaggattctggttctgtaaactgactcaagtttaggaattaatcgaagggcaaggactctgttttggtgattccagttagacttctgttcactcagcctagaactcttctgtatatacagatcacatacgaatttagtagattgcccctctatttcttttttagctgctgcatgatcaaccagccaatgctgtgatctctgtgactcagactcatgattcctgttttgaccccctgtccgtgactgtaaccacacccacgttgcctttggtgattaagtgctgtcatttgtcccctgctccaggatccaattattcccattgcatttagaatcccagcttagtagcagcatttctcattgtaatttctgacattcagataaaaatgaccccagaactcttcaaagatgctgggctcccctgacaaatttatttctcacagttgtagtgaaactaccagggtgaatgagcaggctttacatgacaaattcactctaacattccaattccaatctctctaagcctttgggcaccttcttctaccttcctttacagaataacaatgcagttctggtatttcaacttcatttagtgcaggaccccttttgctccatgtttcagccaaccaaacagccacactgttaaaactcttaactcaaggagctgcaacatgagatccagaatttctgcttagtgggcccatatcagtaaattcagcccaatccaactttatgttccttccactattatcccacacccttgatatccattcccacatatattccctagatttatgtccgtatacattggaaaagtcatgcatttcttttggagtgtagcaccctgccgccaaccataggtcattctttgtacttcaaactttggggcctgctgggacttgagactagttataggtccagaagcaaagaggggtggtgggagtgggttccgaagaagaatcagcactgtctcaaaagataactacctcagaggtggccattacagatgctgcaagcaaaacagtgttaacctcaaactgcagggaggcgatatgcttaggctttgtgtccccacccaaacctcatcttgaattgtaatccccatgtgttgagggagagacctggtgggagatgattggatcatggggtcagtgtcccccatgctgttcttatgacagtgagtgagttctcatgagatctgatggttttataagtgtctgactgttcctccttcacacactcactcactctctcccacctgccaccatgtaagatgtgtctcttccccttccgccatgattgtaagtttcctgaggcttccctagccatgcagaactgtgagtcaattaaacctcttttctttataaattacccagtcttgggcagttctttatagcagttgagaatgaactgatacaggaggaaaggaggatgaagggctgtttctactggcaaaaagacttggcacaatttatgggttcagtgtacccagcttcattgggatctgcccatacgaccccattcaaaatttcaggatctcattctctcctaatccaaaccctcactttaacagcaaataccctgtgaggctgtgaattcaatttccattgtagttctgctattctcaagatgagactctgggtcacttttcagcaatctcagccttgcaggagatacaagagataagggtttgttcctcccccccctgcccccgccggggcagacacagaagctttcaagtaatttatgcagtattttgagctgagaatttgaaactctgagcttattcttttctttccccactttctccagctcagctgagagcagctagcgaatcttattatacttactaatttgactaaaatgttctaaggtatcaaatgcatagtcacccagaaccttgccttttattagtattcggctagtagtatctaatatttgggacatacttgtactaaaaaatcatacattgtttatctgaaattcaaattgaactaggcattctgtatttggtctggcaaccttgctttacagaaatcctctttatcctccaaaattgaagtatatttccaatagactgctccagaaagaagttattactttaattaatattatttattgaccacttacaatgtgtctgttctaagtgctttccataaatgaattcacttaaggcctgattataacttagggctagctattcttttactcccattttacaggagaagctgagcctcagaagagaaaaataagttgcccagtagatcacagcaaaaaggtggtggagtgggatttttacccagacagttaggggtctgggttcacatggataatcatggataacatgacgcgaccttgtgacctcttctaccagaagcttccacagaggtgtgtttgtgccttgtctggggcccttaacatattgttgtctgtctactctagcaggctgtgatatcattggctaatagcagaaatcatgttttatttattgccacatcctcatgtcatgaaacttggaaaaattatatttattattcaactttaaaaagggaggaaattctgacatgtgccacagcatggatgaaccttgaggacattatgctaagtgaaataagccagacataaaatgataaattgtgtgtgattccacttatgtgaggtacctattacagtcaaatccacatagatagaaagtagaatggtggtttctggggcctagggagagggaggtatgggaatgattgattaataagcatacagttatagctgaggatgataaaaatgttctggagatggatggctgtgatggttgtacaactatgcaaaagtatttaatgcccctgaactgtatactaaaaatggttaaaatggtacattttatgtcatgtgtatcttaccacattttaaaataaatgttatacttaacttagcacaggaggttaagagcccaggctcagggttcagtactgtctgagttgaactatggctcagccacttaccagctgtgggatttggggctagtcatttcacatcaatttcatcagtaaaatgtggatggacaataatgcacatatcatgtagttgtgaggacaaagtgaaacaaaatatgctgagtgcttggcacaatggttctcatccccacaaatgggggagatttttaagactatcgaggactagactctcacagataagttaaatctggccttgtgtctttaaacgtttctatttaagaacatttcaaagatacatacaagtgatagatagttctcacataagcataatgtagactgaacatttatcaagattttaacattgaaatatatcacctttttttttttttttttttgagacagggtctcactctgttgttgcccaggctggaatgcaacggcacaacatagctcactgcagtcttaacctcctgagctgaagcaatactctcacctcagcctccttagtagctgggactacaggtgtacaccaccatgcctggctaattttttttttttttggtattttttgtagttatggggttttgctatgtcgcccaggctgatctcaaaatcttgggctcaagctatccacactcttcaacctctcaaagtgctgggattataggcgtaagccaccacacccagtagaatatatcattcttaaaggtgaaagagttattgggacaacacaatgtctggcacatagtacttgtgcaacagatttagctgttattattacttttactctaattagaaatttctttgctttaagtaccttaattttgaaaagggatgctctgaatgggagaggtgcctactgatgtcactgtaaatgtatgactcctattgaaattgtacccagagggttttcttcttctgtgaatcatcctggaagtattctgcatctcaaatggacataaatcaatttgaaccaataacaacgttatttctgaaataccatactgcagtggaatctgacagtaaggtaaaatagagagaaataaatagcatagggaatatggagaggaaatatagtctttcaggcctcaggaaaaagtgcttttaatctgggaatgttctgttatggtactcacccactgcacgcccagggcagacattactaatcaatatactctttcccactgaaccctaaagctgcattagaatttttaagacaatgctttaggtacccaccaacaatcaatgagaggtggcataggagatgagtcgtatatattattctttttttgtacccttttttgtgccttaggtaagtaatactacatacccagaaggaagaaaacgctttctgagagagcaaaacaactgtttgaacttcctcaaaatccaccaaaaacagcaaagtcatttccatggggctatcacagggccatgagccacaggtcattctaagatgtggagtcttagaatccatccaaaaacagctaaaggaaaataacaatagcctggacctggcctggatttctgccatgttggaattggtttgaaataaaagtgttccaacactcttctagttacgaaaattagctttgcctcatgctgccaagtggctaagtctcaaatgtgtatttttccaactttaagttgaagcagtgagaaaactcatagaaaagattaggaaaaaataaggtccatgaaactagtccaatagtggggctgaaaatgacaataatagtaacaatgaaaatttggtgcatattttctatttgccagactttgtgcctaggtgacatgtggttcttctcacttcctctgcacaaacaacctttgagatcagtaccattttcatttgcctttcttagatgacagtcctgaagctcagggaagttaggtaacttgcttgaggccacatgctttgcaagtgatgcagctgtgggatttgagcccaggtatgtctgatttaagacattgtactcttgaacctgtgcattggaggccagcaaggcctttcctttcagcaggaaaagatggcaactaagagtttcagtcatcttcctaacctttctttgacctcactcaaaagggcaagaactcgaatttattcatcattatcttttccattgcattgcataatacctgacatgtaatcagttcacattgagctgaattaatatttggtgaggtttctaaatccagcagtgaactctgcttgcagagcaattgtgggttcttctaaatctttagttgcttgtcttggagccaggttgagtattgttcctgtggctgtgtcccttgtattattagcacatgcattcaacactatttattgagcacctactctatgctaggcagtatggttgcaggatagcagtcaacagaaagacccagtcccagcctttagatttgtagtccagaggggaagacacacttgagcagaagatcatattagcaattgatcatatgcttaattgcatatgtcaattaagagcggatgctacagaggtgctgaagaagggtacctaggggcttacagaaaacactgatggagatggcatcagaatatctaatacatacagtgctagccatgtgtcaagcacagatcttacaatattacatgactcaccttttaaaatcctcataccaattttcaattcctaaagcaaacctctcaccacccatattcatatggggaaactgaagcccagagatgtaaggtaactcactcaaggtcaggacagtaagtggcagagatggactcaaagttgagctgtagctgtaattcaatccctctcctaatctactgtgctgagtcttcccctgggaggtctgaaaaatagttggaattagctttaaaacaggagggggactgttcgagaaagaggaggcggtggttatgaaacccgaattggacagagcttcaggagctgggaggtgttcagaactgtggtggtggcagtggatgagggcagtggtacaggaaggggtgagttgagcaagagttagatctaccaggctgccagggagtgcagctttcatcctaagggcactggtgagttatcagagggctttgcccagggagtgataagatcagatttatcctctaaagtgctcactctggctattgaggagagagagaagagaaggtgctaaggatggaggtagggggagtgtgtggcagggctgggactagggtgagacaagtgaggttcctagggcactgcacttgcacggccctgagagtaaccctctccttcaactttgtgctccagttgccaattgcgtcatccaaatcttagtcctgctatttgggctgctgctgcaagaatctaggccaaggtggtataagccaggcccacaaagcacatcaaggaagctggaaactcatagaaatggaaaatccctttttcacttcttgggtatttatgttcgtttttgactgttagcgcttatcacatgcagttcattttatcttcaacatcagaaagagtggaaagtttcctgggatggaaatctctttgaggttcaatagttctttacaaaaaaaatggcagtagagtcaggggaggtaacagagggagagggagaagagagagcagtggagagggagggggaaaagtatgacataggatgagataagaaactcctttgcaagtgtgaagccaaaggatacataataaaaacaaattccagcagaatggaaagaaaacaaaacgctaccttgaaatgaaatatccattctaaacatgtgcactgcgctttttcagcatcactacagtgtttttgaggtccttttgtgaaagacgttggtcacaaacctatgctttaatctttagccacattttatccaaaggccttgggaacccgtggggtttgctaagactccaccaacgtagacgctcgttcagcagataggatgtttgatgccgcttgctgcaagccctgggaagttcctacgaatcataaagattaaggtgttttttgaagctggtttaaatacacataacacgagagtaacaagccaagtacgagagaatttaaataagctgctctttggagttgctgacactcaggcgtgtgggctcataatttgggattctgaactggagaagattccagaatgaagcttagaagaatgaggtctacttttacctgttctcattctattcttgtcttttggttcttcatttcttaaaatgacctgctggcagcgaccctgtgttagtcccatgggaattactttgtgatttgtggtggattttgaggaaaaggcagttgttttgctctcttggaaattttttgggttctttttgggtacgtagtattgcttaccgaaggcacaaaaaaagggtacaaaatgagagctgggtcctgcagtcaaccacacctgctctgattaaccctcaacccactcgtccctttcatcgttgaatgacattttcaatatcaaccctttgctggttctaaagcacagcagcctgtatttgaatccatttctgttgcatagcttctccgtgaacttgaacaaatttctccacctcttcaagtgtgaaatgggggctaatgatggtactgatttccagggttgctggaagcattaatctaatcacgagaaagtgcatgccaaatgcttggaattagtcctggcacatgctaagcattcattaaatgttagtttttattttcatcaactattggctttcacaaaacttaacaacaacaagcaaaccaaaccctgaggcttcacttttgggaattaaacgattaaatattatgaggtctaagacattaacttttattaatgcataataaatgattacatgtcactaatagattgatatctattaatatacattaaatgattagcttaattacatttaaaaatatctgcaacaactaagaattatatgttgattgatgaaatgggttaaaattaaattaaatgcgttaatatacatgaagcagttacaacaggactcaacatcagatatacactcaactaattatttttttaatttgataatatttgaactctctggagtgactccttcaaaatcacatcatttttggggagacgactgtaagaccaaggaaaaacagtggcattttctcacctaacagtttctcctcaatccatgttccctctatcccctcaatctggtttttctgttttgctcttttctaccttcctgctggtagtcgaagcgagggagaaagagcagaagtaaggtgaggttttacctaacaaatataaatgcttatggtgccttatattttggtgactttaaattttgatataatttcaaatttacagaacagttttaagaataatataaagaactttgattatagcctttatccagattcaaccatggtttatgttgctccattgactctatcagttcctagccctccctccctctctctgtgtatttctgaagtatttgagagtgcctttgtatatgtatttctggatacttgagtgtgtatttcctaagaacaaggtcatccttttacataaccacagttcagctttcaaagtcaggaaatgtaacattgatatattactattatctattccatagtgtattttcaaacttcatcaaatgtcaagttcttttttttaatccagcccaggatccaatctaggatcacaaatgctacttatgtgttttgtctttttaatttccattactctgaaacagttcttcattctttctttgtgtttcttggccttggcatttttgaagagcacaagccagttactttgttaaattattctgaatttggatttttctgctgtttcttcatcctgtatgcaagttatgcatttttggcagaaataccactgaggcattgtctgttgattttataaagcatcttaaagctggtgtcagtaggggtacatttggtggcaagtaaaagactcaactaacactggataaagaacgagaaatctggtggttagtagatccagattggatgtggattctttccattttctactctgctaccctcttcacattgttgtatatggcagtatgtgaactgaacatgacaagaggcttaaagaaggatgaaaggagagattaaagtaatgttctacatttgtcttaacgaggccaacttgttcattagaatgtgaacagaaatgtaataaatacctccatatattacattgccacccatgactgatagctgatggattagaggctgcttccccagaagcagaacctgagacaaggatttatgtacaagtattttatgtgggaagggatcccaggaagcaccagtaagggtgtgaggcagggagggtgaagcaaggaagtatagcagccaggacagggtgtgttgttgagctggttactcctgtggataaccaggtcttggtctcactgggaacctctaggagccacttggagacatgcttcagggtcttgccaccagaaggatgagaaagctggggtactgatgttccaatccctggtatccttggctggaggctgctacagaggcatcagcgccccctgcgtgtataggctaaacagttggaaagcccttggtgggagggtctgcatgctgacagtcagaaactggccaactgcatgatgagagaaagtgatgaggggctctgggtggagcctgggcagtgtctgatcttcctctagctgaaatggacactcctttgtgtgagcactgaactccctcacttctttgttggtgcccatttttccatggggtgagagggtttatcactgtacacattaagccctggtctttctttttctctctctccttgtcccattcaggctctatttcaatctctaagacgtaaggtcatagcctttcacttaaaaaatgttatttgattacatgcacctgtcttttctgtgtttcttccatagggcaagcgtgtgggctttggaacaagccagacttggctccagttctctagttcgtgtgaatgtgagcaggtgactgtcacctttctgagcctcagtttcctcaagtgtaaaatggggatggaatagccgcctttcagggttgcagaaatgaggactaaatacaacatcatatatgagtgcttgacacatacttagaggtagttattacacagagtagcaacatgcatagtagcctgcattgcacctggcataataaatgctaggtaaatggtgagtgtttataattcggggactggcaacgtttttctaaaaagggccagatagaaatattttaagttttgaggcccatatggttcctgttgcagctactcaaatctgcggttttaggatgaaagcagccacaggcgtgtgtatgtttcaataaaactttattgacaaaaaaaagaagtggcccagaagtcgtggtttgctgatccctggtttatgtgattataatgattgttacaaccattgccaggatttgtgtacaagtttactgcccaccaatttggcaaagctcagtccgtttttattttttattttttttttatttttattttttgagatggagtctcgctctgttgcccagaatgcagtggcgcgatcttggcacaccacaagctccgcctcccgggttcacaccattctcccgcctcagcctcccgagtagctgggactacaggcctccaccaccgcgcctggctaattttttgtatttttagtagagacgggttttcaccgggttagccaggatggtctcgatctcctgaccttgtgatccgcccgccttggcctcccaaagtgctgggattacaggcgtgagccaccgcacccggccccatttttattattcatggtagttatgttccataaagccacaacgaacactgaaatagcaaataccaaaatacagctcttagaggaaatacaaggttaggttcctgggagcctctggttgaaacattttttcagccaatcaatacataacctcattttatgtgtgtttctgtttagagacaacttacttaatatatacatgtttttgattcataaacattgaactcagagccaacagcaatataattcacacctgaacaaagcttatctaacatacatattttctctgaaaggcatctcatagcctttttgcattaagggacactaaagagcacttccactctatgcttggggggttggaggagagtgtcactttaaacactgaaggtaccaaaaagagaaagaaagcacaaaaatgcgtcactaactagaccccataaaaagaacacttgtggccaggcgcggtggctcacgcctgtaatcccagcactttgggatgctgaggtgggtagatcacctgaggtcaggagttcgagaccaacctggccaacatggtgaaaccccgtctctatgaaaaatacaaaaattagctgggcgtggtggcggccacctgtaatcccagctactctggaggctgaggcaggagaatcgcttgaacccgggaggcagaggttgcactgagctgaggtcatgccactgcactccagcctgggtgacaagagtgaaactctgtctaaaaaaaaaaaaaaaaaaaaggatgattgttcactgtgtgcgagctaaaacaagtagtcagggtgttgccttgtttgacaggcttagaagtgcatcttaaatgactcaactttttgtgctctgcacatatgcatgtctgtgaataactgtgaaaatgccagaaacgttgattttggggttacagataaattttagtatgtaggccagttcaccaatacaaagaaaaatgaggattgggctgggtgcatggcttacacctgtaatcccagcactttgggaggcagaggctggcggatcacctgaggtcaggagttcgagaccagcctggccaatatggtgaaaccctgtctctactaaaaatacaaaaattagtggggcaatggtggcaggcatctgtaatcccagctactcaggaggctgaggcaggagaattgtttgaaccaggggggtggaggttgtagtgagccaagatcgtgccactgcactccagactgggtgacagagtgagagtctatctcaaaaaaaaaaaaaaaaaaaaaaaaaaaatatatatatatatatatatatatggcttaccctatggactttgcatgatatgttttttatttttattttatcttaggctttccagtttttaactctttaattatttaaataatttcatgaatatatgttcaacataaaaacattaaaatgacacacagctataaagaataaaaagtaagttattcttcacattccttttgtactagattccagtttttttctccagaggtcaaacagctcatagtgtgatctttttgagatttaaacacacatgtgtatgtacacaaaacacactactttaaaaagtaaatgggccacacaaaaacctgcacataaatgtctaaagcagctttatcggtaattgccaaaacttggaagcagccaagatgccttttagtttggtaaactgtgaagcctccagacagtggagtattattcagctttaaaaagaaatgagccattgagccatgagaagatacggaggaaccttaaatgcttattactaagagaaagaagccaatctgaaaaggctgcatatgggatgattctaactatatgacatattggaaaaggcgaaactatggtaacagtgaaaacccagaaatagcccaaatgtctatcaagtgtaaaaattgataaattgtggaatactaaaaaagaatttgctgttattactagtatcctagaagtaggattgctgaatcaaaagttatgtgcattttagatcttaatatcacaaacccctcatcccaccctccaaaaccctccagaagagaggctctttcaatttccattcccaccaacagccattgagactccctgtttgcctgtacccttgccaatactgggtactatccattaatttaccttttgccaatctgatgggctcatcctcctttacaactgaaattcttacaactgggacctgtcataaaattggtgtgtaggagcctttgagaaggctgtcggcaaatgaagcaaaaactccaaccctctaattttccacacactgatttaggctctttggaagattaacaaatggttatcagggtaattctgaaaagaagtgggggcagagattcccacacagaacctaatgttttctgggttggtgggggtgggggggctttgatttgaatggctccaggaccccctctgccagatgtcagcaaatcacagacattcatctagctgaaagccaacctattcagtctttctgggcaacacattcagacagaacccagcattcttggctcagggtgatgaaataaataggacttaatttatattttaaagtctttttatctctctgtaagcccctgtgcttcattgaaagaaaatttgatcgagatgtagagaggtcagaatgcagctttaataattcacgatctgtaatcttggccctttcttactttgccttaacatttatttggaggtttgccatttccctctgcttcccctacatgattcttgagcgacagtcttgtccttcttctaaactctcttgcctcagcattcagaccgtttcgggtaggatcggaaggtttgatatccactttgaccaatgagagactttgggggcaaactggggcccctgaccctctctccaggagccttgatctgccagttagaatatcttatattgataagattagttggtaattaacagcccagcccagtcaagcagaggagatgactcaattagcagaatgtcactccatctaatttactttgcttatcagagatttattttctaatgactacaggaagaagaacagggcaccttcagaggagggatcagaaagggtttaaaagcttcagtgtgctctaacctctctttttcagctggtttgcctggcagtgaggaggctgataatgccaatttggggaattggctggtctgatacacctatctcaaacttgggaaaaaagaggttgaatgtttctgttatccctctatctgattcttttctttatttttaagttttgtgggtacatagtaggtgtatacatttatggggtacatgggatgttttgatacagacatgcaatgtgaaataatcaaatcatggagaatggggtatccatcctctcaagcatttatcctttgtgttacaaacaacccaattatactcttttagttattttcaaatgtaaaattaagttattgtctattgtcacccctttgtgctcacatagtaggtcttatacattctttctaactatcctctatctgctttatattttttgagctaatcctgtttgtcatctttgtttgatgagaaaactcctcccacagctacttagctttagctagagtagtagtagcaataacaccacctacaataatactagacaaggtatttattaaagcctcttgataccccaggcattgtgttaaagactttacattggacacataacattgaatcctctacaccacagttggcaaacattttcttaaagggctagataatattgtagttctggggaccggtctttgttgaaactgcccaagtttgattgtattaagaaagcagtcatagactataggcaaataactaagtatgacttgttccaataaaactttatttacaataacagtcatttggccagatttcggctgttggccatagtttgctaacgcctactttaaatcagtgtttctcagacttcatattgtgatttatttagtcacagaatcaatgtagatggttgcaaaactcattttttaaaaacatgaaatagaataaaaactatgtggctgggcatggtggctcacacctgcaatcccagcactttgggaggctaaggcaggtggatcacttgaggtcaggagtttgagaccagcctggccaatatggtgaaaccctgtctctactaaaattactaaaaaattagccagccatggtggcatatgcttgtaatcccagctactcaggaggctgaggcaggggaatcccttgaacctaggaggcgagcctgcagtgagccgagattgccccactgcactccagcctgggtgacaaagtgaggctctgtctcaaaagaaaagaaaaagaataaaaactatgtgaatgcatcacctctaatatggataactcctatttggtgaaattttaatttcagatgtgcgtgtatgtaaaaccatatatgcatatggatataggtgtgtatgtatttgtgtgcgtgtgagtactgggtttcaatgtgaagtgtgtatcttattgcagattataagagtttgaaaagtcctgctcttaactacctaaagtaagtctcattattacatgcattttacggttgaggaaatagagatgtggaaagacattcggtgacttgccccaagttacacagcctgaggagccagattttttgataagacagcaagcctctgacatacagcattttcccatgcccactttggaatgggttaatagcagtgaaatggttaaaattccttccagtggaaggaaaataaaacaagggacaggcatagtccacaaattgaatggcttcttgctgaagcgaacagaaacgtctctttttccttcttggtattttcattgcaaatactatttatcacaatgtatttttcccccaacgcattttagaaagtcagttggaattgatttgaggctctaaacagtctcctgaatgaaaaagcaaagtgtaacctattctaacagcccctcttccttaatctagaaacatggggagatgcaatttaaatgataatgttaaccaaaacgggagaatgcaatgctatagtaggagtgtttgttttgttgtttttttaacccccactgaaagacaaatggctgagacatttatatctgcagcacttattaaggagaaaatgctcaacccgttaatttcattgctgtggtgctgaatatgaagaaagaatgtagtttctgagtgactgctgaggactcccacagtcctacaagatggcggccagggagggggattctgtggcaacgttcgagaagtcctgaaatgtcgtccgttatctaacatttatctgggtgttgcagaataagtgtttctcgaagtgagacttcttggaacattttctcttaaactgaggctttggagtcactttgtaagtttgtgttttaaagccaaccctctaaaacttgtttgctgatcaatttaaagacaggtctccctggcaaccatgttgtacacagggtatggattatgtatacagaagatagaacgtagagttatctgaaataatatgttagtttcagtaagaaaagaattagtcagaaataaaataaagtaagcatattaggattttttttaaaagtgtgccccaatttaaaaacacatctataggaaataaggaagaatatacactttgatgattctgctacctaacaagacgaccattactattttataatgggttttgtttttccatcttttttctttcttttttttttttttaaagtgctttggttaagaagcctcacaactctccccagttaacaccttcataaggaaagcaaaattacaagacggcaaatgtaccaattaggactcagtttacctgtgttttcatgctccagagtgtttgatacacatttaacaacaagcgatgtttagaggagggagcccaaactacctctacccataagactcctctaaagtatctagggtatttataccatgccctaacatcttagctgtgccttgcaggtttttgcataccaaggctttgtgggcaaaagatccagaactaaacgacatctacctagtctatgttacaggctgtgccttcaaatgtcaagctttgctaaccatgtctcattatccaacaagcttagtttttctgatggctaccatgtccagtgtcgctcagagaacttccaaaatttcctatactatgtacgcccattgattgaatatatatacacatgcatacacacacatacatacatgcatatacatatacacacatattattttgcatatgtttatatatcttcacatacataaacatacatatgaccaaaatttatacatgcatctactttaaagagccaaggttctaaaaagcttgttataaagagcaataacttgcttctcctcatttccttccatttctctcccttcggaggcaaccactgttgtctcttgtagctgattcttttggtaccttcggatacttaaatggcatgtttataatgtgatgtcttgatttctcatattcaggtattaactgttgttttttttcctcaaggaaaatgagaatttcgctttcttgcccctccctccctgcctccacgacctctacccacaacgcacacacttcctgtctgagtcttttgcaatgatttttgatagtttaatattcgttatttccctgtgtcatgaccatgccaaatgccttccacagttgcatcatgttctgtgatatttttttcctttactgcacaactttttgttttccatgaagttaataatagttgccttttaaaaatttgcttaacgttttgtatgatctcaaccctggttcagtctccaatttttggctagttctgtaactctcctctgattgtatccctctgtatcacaaagctattaattctactttccaggagtatgaagatcctggggcttcaagcctgctctctgctccctacaccaggggagcaaactcattctgggcaatcccctctgtccatcctctgtagtggagatcctatttctcaaagaaccatatgttctatgttcttggtttatcccctcaatttcgttgagtacttctcttactagccttctgaaaaaggacttattattattattggagatgttgcatataggtgttggctatagaatcctaggttggaaatataaacctcaaatatttgagacaggtcccagtcaatttagaaagtttattttgctaaaataaactttagcaaaaaaaggttaaggacgtgtgcccatgacaactcagcctcagtaggtcctgatgataggtgcccaaggtgcccagggcacagcctggtttttgtacattttagggagacgtgagacatcaatcaatatatgtaagatgaacgtgggccaggcgcggtggcgcacgcctgtaatcccggcacttcaggaggccgaggcgggtggatcacctgaggtcaggagttcaagaccagcttgactaacatggtgaaaccccatctctactaaatacaagaaaaaaaattagtcgagcggggtggtgcatgcctgtaatcccagctactggggaggctgaggtaggagaatcacttgaatccgggaggcggaggttgcagtgagccgagatcgtgccattgcactccagcctgggcaacaagagcgaaacaccatctcaaaaaaaaaaaaaatgttgaaagctggttgggtccagaaaggcaagatgactcaaagtggggaggggacttccaggtcataggtagataacagacaaaaggttgcattcttttgagtttctgattagcctttccaaaggagacaatcagataagcatttatctcagtgagtagaggggtgactttgaatagaatgggaagcaggtttgccctaagcaggtccaagcttgacttctccctttagcttagtgattttggagtctcaagatttattttcttttcacagaaatcgctttcctcaaaattttgaagacgtgactcccctgtcttctagcttttagaattgctgctgagaagtctaaagccactctgattctgactctttgcatataatctgctttttctcttggtaaatgtgtaaaatttctttgatcctggattttgaaaatgccacagcaatgtgcctcagtgtaccttggtcatggtgctggtcttttgaacctgggaacacacgctcttcaattctggagaattttcttgagttatctaatggataattttctcctctccatttttttttcttgttttctctttctaaaactcttgttattcagatgtcagttcactattttttaaaaaaaattcttctctcttattttgcatccctttgtctttttgctctcttttggaaaaatttgtcagtctcatcttccaacctttttacttttactcatcttccaacctttttactaacgcattcatttgtgcgttagcttctgagggcttcttttgcatccctttgtctttttgctctcttctggaaaaatttgtcagtctcatcttccatcctttttactaacgcatgtgcgttaacttctgagggcttcttttggcttttcacgtgttcctgtttacagtcccaagtagagtatttggcacaatgccctaaggcatggtagagtaacagcaaggaggatgatgtgcttggaacaatgtgagcaagagtgactgtgggagccaacaaagctatgaaagataattggaggaggcacatcacatagcacattatggaactctgactccaagtggtgaagctggagtctaagcctagctttgtccctgctttggaaaactcagtctttctgatcctcagttttcctacttgtaaaattaactgtttgaatttctaagaaaccttacaactcaaatatgctcatgaatctttgattacatcaatgttctctccctaaagcaggcaaatcacaacacttaaatttgtgtatatatatttatgcttttctagatgcccaagtatatatgacttctaccatccagtaaaacagaccttttaccctttaggaaattacaggttgagagttaaattctataattagtaagtattgttttattggaacaaagattaggtttccccaaagtcgtagaaattaatggcaaggtcagattagcatgagggtctttggtcttctagcgttcccaactccattgcagaagctctgagcaagtcaactctctcagccatgaccaagaagaagctaattcatctgaaggaaaatgctgagcctgccttcagagtccttcagagtaaacctgctgcacaattagctgaaggaaagggccttgcagggagtcagcacatcagaaatgcaccattactcagccaggggctgacattcagccaatggcagccccttgtgtagatactggagtggatcccacggagaatgagcccgctcacccagcatggggtttacagccgccatgaacctggaggagaggacatttgggccagagcattttggcttcctctgctgtttgagatgggtttgtcaccaggagcaagcctttgctgagttctccctcctttaaagaattgttttctctaaattaattaaattgatgagaataaagagggccaaattgatggcacccaaatgcatttgaaagtgatcagaaaccgccaggaacaccataaattccataattagaaagtattttcttaaagggacaaagatcggatttccccatttcagagttggaaatgccccttgattaatttcctccagcctgtctcttaatgatatgaaatgcaatcaagataagtaatcaagaaaatcaaagtgtcctaagtactttaggtaataatgacaataacattcaaccactgcaataaccagagttatatattatttgtgcgtttttaaacctcatactagacactgtactaaacatgtcaaaagccttgtcccatttaatacctagaaaacaccatgaggtagaaactattcttcttgccattttacagatgacttcaggtgacctgcttggaaagctttgtcagttgtccacagtgatgcagcaagtgaggggtggagctggaatttgaacccaggctgtcaaaatgcaaagtccagtcctctgaactattatgctataatgcctcttaaagttttttttcctattgtcaactctgaatgtcatgttgagtataggagaggaagtgtatcttttctttctcagtcatcagggaaagaacattcattttgctgttgtttttaacttctttttttttttttttttttttttttctgagacaaggtcttgctctgtatcccaggctggagggcagtggtacgaacttggctcactgcaacctctgccccccgggttcaagcgattctcctgcctcagccacctgagtagctgggattacagacatgtgccaccatgcccagctaatttttgtatttttagtagagacaaggtttcaccatgttggccagtctggtctcaaactcctggcctcaagtgatctgcctgccttggcctctgaaagtgctgggattacaagtatgagccacaacacctggcctattttgcaattttttcaatgtggcaaaatatatacaacacataattgaccattttaaccatttttaagtgtacaagtcagcattaagtacattacaatgttgtgcaattatcacactatttccagaactttccatcttcctaaacagaaattctgtgcctattaaacagtatctttccattcctctcttcccctaatccctggtaacttctattttctgtctctgtgaatttgcctattctgggtatcttatacaagtggagtcatacagtatttgttcttttgtgtctgacctcttgctcttagcataacgtctccaaggttcttcctcctcctttttttttttttttttttttatgagatggaatctggctttgtctcccaggctggagtgcaatggcacgatctcagctcactgcaacctccgcctcccaggttcaagcaattctcctgcctcagcctcccaagtagctgggattacaggcatgtgccaccacgcctggctaattttgtattttttttttttttttttgagacagagtttcactcttgttgcccaggctggagtgcaatggctccatctcggctcactgcaacctccggctcctgggttcaagcgattctcctgcctcagcctcctgagtagctgggattacaggtgcacagcaccatgcccggctaattttgtatttttagtagagatggggttttgccatgttggccaggctggcctcgaactcctgacctcaggtgatctgcccacctcggcctgccgaagtgctgggattacagacatgagccactgtgcccagccttttattattattattattattattattattattattattattatactttaagttctgggatccatgtgcagaacatacagttttgttacataggtatacacatgccatggtggtttgctgcacccatcaacctgtcatctacattaggtatttctcataatgctatccctcccctagccccctacctcccgacaggccccgatgtgtgatattcccctccctgtgtccatgtgttcttattgttcaactccctcttatgagtgagaacatgcggtgttaggttttctgttcctgtgttagtttgctgagaatgatggtttacagcttcatccatgtccctgcgaaggacatgaactcatcgttttttatggctgcatagtattccatggtgaatatgtgtcacattttctttatctggtctatcaatgacggacatttgggttggttccaagtctttgctattgtgaacagtgctgtaataaacatgtgtgtgcatgtgtctgtatagtagaatgatttataatcctttgggtatatacccagtaatgggattgctgggtcaaatggtatttctagttctagatccttgaggaatcaccacactgccttccacaatggttgaactactttacagtcagtgtaaaagcattcctatttctccgcatcctccccagcatctgttgtttcctgactttttaatgatggccattctaactggcatgagatggtatcgcattgtggctttgatttgcatttctctgatgaccagtgacgatgagcattttttcatgtgtctgttggctacatagatatcttcttttgagaagtgtctgtttatatccttcactcactttttggtggggttgtttgtttcttgtgaattttagttcttgtagattctggatattagaccttcgtcagatgggtagattgcaaaaattttctcccattctgtaggttgcctgttcactctgatgatagtgtcttttgctgtgcagaagttctttagtttaattagatcccatttgtcaattttggcttttgttgccattgcttttggtgtttttatcatgaagtctttgctcatgactatgtcctgagtgatattgcctaggttttcttctagggtttttgtggttttaggtcttatgtttaagtctttaatccatcttgagttaatttttgtgtaaggtgtaaggaaggggtccagtctcagttttctgcatatggctagccagttttcacaacaccatttattaaatagggaatcctttcctcattgcttgtttttgtcaggtttgtcaaagatccaatggttgtagatgtgtggtattatttctgaggcctctgctctgttccattggtctatatatctgttttggtaccagtaccatgctgttttggttactgtagccttgtagtatagtttgaagtcaggtagcgtgatacctccaggtttgttctttttgcttaggattgtcttgcctatgcagcctctttttttggttccatatgaaatttagtttttttaaaattctgtgaagaaagtccatggtagcttcatggggatagcattgaatctataaattgctttgggcagtatggccattttcacgatattgattcttcctatcaattagcatggattgtttctcaatttgtttgtgtcctctcttatttccttgggcagtggtttgtagttctccttgaagaggttcttcacatcccttgtaagatggattcctaggcattttattctctttgtagcaattgtgaatgggagttcactcatgatttggctctcttattggtgtacaggaatgcttgtaatttttgcacattggttttgtatcctgagactttgctgaagttgcttatcagcttaaggagattttgggctgagacaatggggttttctaaatatggaatcatgtcatctgcaaacagagacaatttaacttcctctcttcctatttgaatacactttatttctttctcttgcctgattgccctggccagaacttccaatactatgttgaataggagtgatgagagagggcatccttgccttgtgctggttttcaaagggaatgcttccagttttttcccattcagtacgatattggctgtgggcttgtcataaatagctcttattgttttgatatacgttccatcaatacatagtttattgatggtttttagcatgaaggggtgttgaattttatcgaaggccttttctgcatctattgaaatacgtatgtggatttcgtcattggttctgtttatgtgatggattacgtttattgaatgcatatgttgaatcagccttgcatcccagtgatgaagccaacttgatcgtggtggataagctttctgatgtgctgctggatttagtttgccagtcttttattgaggatttttgcatcaatgttcttcaaggatattggcctgaaattttctttttttgttgtgtctctgccaggttttggtatcaggatgatgctggcctcataaaatgagttagggaggattccctctttttctattgattggaataatttcagaaggaatggtaccagctcctctttgtacctctggtagaattcggctgtgaatccgtcaggtcctggactttttttggctggtagagtattaattactgcctcgatttcagaacttgttattggtctattcagggatttgacttctgcctggtttagacttgggagggtgtatgtatctaggaatttatccacttcttctggattttctagttcatttgtgtagaggtgtttatattattctctgatggtagtttgtatttctgtgggatcagtggtgatatcctctttatccttttttattgtgtctatttgattcttctctattttcttctttattagtctggctagcggtctatctattttgttgatcttttataaaaaaaacaactcctgggttcattgattttttgaagggttttttgtgtctctatctctttcagttcttctctgatcttagttatttcttgtcttctgctagcttttgaatttgtttgctcttgcttctatagttcttttaattgtgatgttagggtgttgattttagatctttcctgctttctcttatgggcatttagtgctatgaatttcactctaaacactgctttagctgtgtcccagagattctggtacattatatctttgttctcattggtttcaaagaacttatttatttctgccttaattttattatttacccatcagtcattcaggggcaggttgttcagtttccatgtggttgtgaagttttgaatgagtttcttaatcctgagttgtaatttgattgcactgtggtctgagagagagtttgttatgatttctgtttgtttgcatttgctgaggagtgctttacttccaattatgtggtcagttttggaataagtgtgatgtggtgctgagaagaatgtatgttctgctgatttgggtggggagttctatagatgtctatttggtctgcttggtgcagagctgagttcaagacctgagtatctttgttaattttctgtctcattgatctgtctaatattgacagtgcggtgttaaagtctcccactattactgtgtgggagtctaagtctcaatgtaggtctctaagaacttgctttatgaatctgggtgctcctgtattgggtgcttatatatgtaggatagttagctcttcttgttgcattggtccctttaccattatgtaatggccttctttgtctcttttgatctttcctggtttgaagtctgttttatcagagacaaggattgcaacccctgcttttttgttttttgttttttgctttccatttgcttggtaaacatccctctatccttttattttgagcctttattttgagcctatgtgtgcctttgcatgtgagatgaatctcctgaatatagcacgctgatcagtcttgattcttcatccaatttgccagtctatgtcttttaattgggacatttagcctgtttacatttaaggttaatatcgttatgtgtgaatttgatcctgtcattatgatgctagctggttattttgcccattaattcattcagtttcttcgtagtgtcaatggtctttaccatttggtatgtttttgcagtggctcgtactggttgttcctttccatgtttagtccttccttctggagctcttgtaagacaggcctggtagtgacaaaatctctcagcatttgctcgtctgtaaaggattttatttcttttttttttttttttccttttttgagatggaatctggctttgtcacccaggctggggtgcagtgtcacgatctcggctcactgcaactctccgcctcccaagttcaagcaatgctcctgcctcagccttccaagtagctaggattacaggtgtgcaccactacgcctggctaatttttgtattttagtagaggtggggttttgccatgttggccaggctggcctcaaactcctcacctcaggtgatctgcccgtgtccgcctcccgaagtgctggggttgcaggcatgagccaccacgcccgcccggccttcttttttttttttttttttttacatagcaagctgctaagtgcatctctgtttagaaattgccttaacattgggtttctattgacagaacaggggaggagtttgcctctgacttttctgaagctcccatggtacctgaggctaagcagcccacagttaattttaattggcaaaagaaatgagaacaaattcctccaggatgagaagtacatttctgctaaaacagtgctctcccacagggtatatgaacacattcagtcccctctagaaaagaaccagagggcaggcacggggtgccagctgctagaaatcttgcagttagattagaatagaagagtgtctgagtttttagataattttaggtgccaggatatggttaggaggctatgttcagggctactcttgctactgttgaaataaaaaacaaaaataactgcctagagaacatccacgccctaaaagacaaaccatgttttctgggtgaagggatgatttaactcaggaaactcaagaacacaaaacaacaacaacagaaataatctccttgaacatattcaactagaatggcaaggcattttccaacataaaacactgtaattttcctgctactccaaaggaatccaataaataattttacaaaattataatcaaaactggaagtcatggccaggtgcgttggctcatgcctgtaatcccagcactctgggaggctgaggtgggtggatcacaaggtcaggagttcaagaccagcctggccaacacagtgaaaccctgtctctactaaaattacaaaaattagcaggtgcctgtaatcccagctactcaggaggctgaggcaggagaatgggttgaacccgggaggcagaggttgcagtgagcccagatcgcgccactgcactccagcctgggcaacagagctagactccgtctccaaaagaaaaaaaaaaaaaaacctgaaagtgacaccagccccctgacaacacaagtcacaggtccttgtgcagtcccagggttgagtggtccaagaaagccactccctgagcccagcctgaggtttcatctttcccgaatgggatcaggtagagggtccatgctgctttgcagaagatttgcatctggtaagcccaggtggtgaatgaaggcaaagaagacaacacgagaagatgtcaaagccaaggtttcctcgcgctgaagccaggccttaggaggcaagttctttggtggggcctctttgcccaagctggagcaagtaccctgtacctgtcatgcagggaagagtttgggtgggctttctacttagcaggactttgctatggagtcctggtaggtgttctcatgttgcatgctctgagatgaggtcctgcatgtggccaggcacaactcaaagtgttcttcgactgccatgaagaggttctggaaagccacagctgcccgacggaggaagcactccaagaaaagctgcttgttgggcagcagccgcgggaccagcagccatcacagcagtattgctttgtgccagagacattgatgttacagcagccgctgggccagcagccatcgcagcagtactgctttgttccagggacgttgatgttgcagcagcccctgggcgagcagccatcacagcagtattgctttgtgctggggccgttggtgttacagcagctgctgggccagcagccatcacagcagtattactttgttccagggatgttgatgttgcagcagctgctgggccagcagcggttgggccagcagctgtagcagcagtattgctttgtgctagggacattgatgttgcagcagcagttgggccagcagccatggcagcagtattgctttgttccagggatgttgatgttgcagcagccattgggccagcagccatggcagcagtattgctttgtgctagggtcgttgacgttgcagcagccatccaccagcaaatccttcctctcacaaacatagttcatctatgatgtggtgctcccctcaaatggagtggtggcactgattgctggggtgactgccattgcccgagttaaactgcactttacacggaatgggctgatcatggtcttgaacctagaggagattcctctctttcactgtcctctcctcctgcttgaaggtgctcctgaggaagtagatgagtgacagcccaaagaccagggcgagcacccacctcctccgcagacatcggtgctaaaccgtggcctcctggttcaccatcccgtgttgtggaacatggcaggcccgaggctcctacacaccccgcagccccatcccttgaagcaggcactgaccccgtggcccatggccgagtcccaggtttatttttcttaccccatatatcagaatttaattcctttttatgatgaatgatattccaaggcatgttcctttctttggtagccgtcctaattggtgtgaagtggtgtcccattgtggtttgttttgttttgttttttgtttttttgaattattattatttttttgagaggagtgtcactctgtcaccaggctagagtgcagtggcgcgaccttgtctcactgcaacctctgcctcccaggttcaagtgattctcctgcctcagcctcctgagtagctgggatcataggtgcctgccaccacacctggctaattttttatttttagtagagacagggtttcaccatgttgaccaggatggtcctgatctcttgaccttgtgatccacccacctcagcctcccaaaatgctgggattacaggtgtgaaccaccctgcctggtccacattgtggttttgagttgtgtttccttaatgatgaatgatgttgagctgattggccatttgtgtatcttctctggagaaatgtctattcaagtcctttgttcatttttgaactgtgctgtttgttttttgttgctattaagttataggagttctttacatattctgaatattaattcttatcaggtatatgatttgcaaatatttcctctcatttggtgggttgtcttttcactcttttgataatgtccttcgatccaaaaaaattataatttgatgaagtccaattcatgtattttttctttgttgcctgtgcttttgctatcatatttcagacattattgccaaatacaatgccatagaaattttcctatatgttttcttctaagaggtttgtagtcttagctcttatatttaggtctttgatccattttgagctacattttgtaaatagtataaaggagccaactttatgtttttgtatgtgaatatctagttttaccagcaccatttactgaaaagatgacccttttcccctattaaaaatcattaggccatatatgtaagagtttatttctagggtccttattgtattcctttggtgtagatgtctgtccttataccagtactacactgttttgattactgtagctttgcagtaagttttgcaatcagaaagaaacttttcttccaagaaaagttggtttaattcacatgagatgaaaattaaaatgtgggtaagtcttagattggttaacgcagaggaagtagcactcaagctattttgaagaccaaagttcatcatctaagccacagtcctcctcagagctcatgcccaccaatctttaatattacaaatggaggaagggtagggatggagatcaaggatagtgctggcaagggtatgaattggtccgacctttttggagggcatttgggaataagaatcacaacacttggatatgggttactgtttgacccaggaattatgttttcaggtagagtaataacaaatggacttgcacagaaattttcctgcaaagatgttcaacccacattgttagcatagcaatgaacaacaaaaaaagtttgagtggcactggctaaattatggtgcaaccatacaatgggatacccgttggctgttagaaacacgtgttgaagcctatttgtagacatgaaaagatgataagtatttaaatttgaaaaaaaaaacaccattatatgtactatgcaatttcacaattgtcagatttggagatcataaaatatccaaacacacacacacacacacacacacacacacacccacacacactctggaagggtagatgctattactaatcgtcgttatattaggtctggctttccaaaagcaggtcctaagagaaggattcacgtgcaacagatttattttttattaattaattaattaatttactttttgagatggagtcttgctctgttgccaggctggagtgcagtggtgcgatctcaactcactgcaacctctgcctcctgggttcaagtgattctcctgccttagccttctgagtacctgggattacaggcgcgcaccaccatacctggctaattttttgtatttttagtagagatagtagagacggggttcaccacattggccaggatggtctcaatctcctgaccttgtgatccacctgcttcggcctcccaaagtgctgagattacaggcgtgaaccaccacgccggccacaacagatttattaagggagtgcttccaggagaaactggtaagggagtgggagaaacagggcagaaaaggataggaagcaaagccagcatgcaattttaggccaagtccgatacagcaggggtccccaactggtctatgggaccaatacctgtccatggactattaggagctgggctgcacagcaggagatgagtggtgggtgaacgagtaaagctccatctgtatttacagccacttcccattgcttacattgctgcttaaactccacctcccgttggatcagtggcagcattagattctcataggatcacaaatcctactgtgaactgcacatgtgagggatctaggctgtgagctccttatgagaatctaatgcctgatgatctgtcactgcctcccatcacctccagatgtgattttctagtgaaggacaaacaagctcagggctcccactgattctacattatggcgagttgtacaattatttcattatatattacaatgtagtaataatagaaataaagtgcacaataaatgtaatgcacgtgaatcatcccaaaaccatgcccccaccatgcatggaaaaattgtcttccacaaacgtggtccctgatgccaaaaaggtggggacccctgccatagaggataacttcagcctgatctcacagagaaattctaagtgtaaattacaccttaggtttattctaacccaaggcaaggaagctgggctttcaaactccttcactcagcagtcattggttaaaggccaccctggacggggatgtaaaaatcccagacatgatgaatgcagctgctccagtagcctgaaggcaggccttcgaggcaaagccacaggtgcaggccattgggagcaaaagcttaccaatgttgaggaagagatgtgaagaaatggtaaagggattttaggggatgtgagtggagcatgccatttagcattctttaaatttttgtagatgaggaaaatgcattatttttgtaataacaacatgtcatttaaaaattactgttgaacaaatacctttcaaattcctctacaatctcacatctatttcacagaattatgtttggtattctgtgggggaaaaaaggctttttcttcttggctgagtctgtatattaaaaataaagaaaaaaaggctttttctcatagccctgcttcagtgactgtcttggcaatattctaataaagctatgaggcttcaaaatccttaccccagagaccaacctatatcattaagggtaataaatacagtcaaaacaatcatgacaacaatgacatgtggaactatcctgtacattaatattgataataatagtgacatgtattggagtgctgtatgggctgggtcctgggtgaagcactttacatgcattctctcattaaattatctgaataatcctattagttaattacagtgattatgcccatttcccagatgtgaaaactaagggccaaaaaacgttaagtaatttgctccagcaaaaccaataaaaggcagagtctggactcagctcaggtttgccttgtgccaaagctcatgtttgaaatctctgcactgtgatatatcccaatccatgtgcttctcttatattttaaggaacattaagtcttgaattctgatcatgggccagttcttctgttatattgtactcctttttacatgtaatcctgagaatatttttctgctggttttcccagccttattggacaattcatttgaacttctttctatttataatctcataggaaaagggctgatgtatttgtaaaattataagcaaaaacccgtcattgtccatggagaatacctgccccagtgcaggctgtgttgaacattttataatattcaaacttcaatcactgcattccccaaatgatagctttctctgatctaaggggaaaccttacctttttgtctgctgcaaatatacatgttaaaatggacagaggccaacaggtatattataatgtgagaaaagcactttctaggacagtagaataagggtgataattttagaaattgccaaataggatagatgggtggcttctttcttttccttaactgctttcttttcatcttcagcttcagtctaaattcctggtatagaactctacatgacacaggttgaaagaaatagaaacaagcatatagtttaaaagaaataggatttcttcccaggttaaatttctagctaaggattaatttgcttgcaccagactcataactttccagatttctgtttgcttatgtatgagggggaaaaaaagctcagctaggctgaatatagcgattagttaaattgctcagacattcattattgaaaaacctcaattccacttgaagttggggtttgtttagcactcactgacaataactttctgcttgactgatggctactaattttgatagtggtatgggaatgtcagtcacaaatagaaatagacacacagactctaggacccattaagctggttaccatgctcacatccccaaatgtgtgttgtttcaaaatataggctaaagagatttaattacattctgggataggaaacatttacgtttcaagtttgcactggttgggggatgctaacagagaaaagaagagtaatgaagcagagagatctcggggaatcaggagagcatcacacctgctgacaggtgcaaagaacagacctaacatctgtgaaggaaaagtcgagtacttcaggaacaaggtggtgggaaattaaagcaccaagagatgttaagctgctccaggaaacaggctgggagactgattgtttgtctcaatcaagagatggctgcacctaaaaataaggatagagcccatcagactttcttttctccctcttctttcagcccattggccttgatttggtcttaaggcatgaaaggaagcctcacggagcccagctacattttcatgccgtgaaaatgagcacttaaaatgtaaacagttctcccaactgcatgtgctgaaggcaaatggattcggaagaacttcacccactgttctcagggaatggttgctctgtggggtgtctctgagacccacaaggctaaggttctcattgtgtttgtttattttattttagttttcagataagcaaaccaaggcttagagaggacagagagcttgggttggcagtccggtgccacgcttaaacaaataggctcaaattctggatctgccgcttctcaaatcactgggtgatttgagcaaatttcagtctccctgagcctctgcttcttctatgaagtgggaagaaaagactattgatgacttagcatcaactattaggactagcgggaaggaggcatgtaaaaggtactacatgtatttaatgcagatttattgagcactcactatgtcccaggcaatgttctagttgctgtataacctggcttttttctgttgtggaatttctttttattcttattttttgattaaaaaattatttttatattttgtgggtacataggtgtatatatttatggagtacacaagatgttttgatacaggcatgcaatgtgtgaaaatcacatgatggagaatggggtatccatcccctcaagcattgatccttcctgttacaaacaatccagttatactcttttagttattttaaaaagtacaattaagttattattgactatagtcaccctgttgtgttatcaaagagtaggttttattcattcttttttgggggggtacccattaaccatgcccccgcacacaacccttcccagcctctggtaaccattgattgattgattgattgattgatagagacaaggtctccgtctgtcttccaggctggagtgcagtggcgcaatttcagctcacagcagcctccgcctctgcctcctgggttcaagtaattctcatgcctcagcctcctgggtagctgaaactacaggcaagtgccaacatgcctggctaattttttttaatttaaaaaaactttttttaatttaaaaaaactttttttaatttttagtagagatggtgtttcaccatgttggccaggctggtcttgaactcctgacttcagatgatccgcgcacttcagcctcccaaagtgctgggtttacaggcgtgagccaccgtgcccgaccaccatcctttacataaccttgctttttcccattgggtgagagatacagctaatagtcacagcaactgacctttatcaaatgtctattgtgtgccaagccactgtgtttatctttttttttttttttgctttttgagacggagtcttattctatcgcccaggctggagtgcagtggtacaatcttggctcactgcaacctctgcctcccaggttcaagcgattctcctgcctcagcctcccaagtagctgggactacaggcgcacaccaccacagccagctaatttttgtatttttagtagagatggggttttgccatgttggccagaccagtctcaaactcctgacctcaggtgatccacccaccttggcctcccaaagtgctgggattacaggcgtgagccactgcgcctggcctgtgtttatcttacacacatatctcattctaatagacagaaaccctaataagaggcaggtgctgtttttttgtttctttgtttgtttgttttgttttgttttgtttttgagatggagtctctctgtgtggcccaggctggagtgcagtggcacgatctcggctcactgcaagctccgcctcccaggttcaagccattctcctgcctcagcctccccagtagctgggactacaggcgcctgccaccacacctggctaattttttgtatttttagtagagacagggtttcaccgtgttagccaggatggtctcaatctcctgaccttgtgatctgcccgcctcggccttgcaaagtgctgggattacaggcgtgagccaccgtgtccggcaggtactgtttttatccctattgtgtcgataaggaaactgaggcttaaagagagacattgagtcatttgcccaaggtcgcacctctagcaggtgtggggctgggattcattccattatcccttacaacaaataattattgaacatctactgggccacacactgcactagaaacagagaaggcaacaatgagtaaataggtaggacaagctttctgtcctaatggcacttacattccagtggagacacctgcaccaattcctggtgcaactaagactttgttcggatggtggcggtgtgtgagggctaagggtgaggatctgacctggttgggaggagtgacatttaaactgagatctgcaaggtggggtgtgtgaagaatgctccaggctagaggccattttcacagtgtcctcactcctcatgcctgtccctcctgcctattcaacaacagcattggctccaaccctggttggtggtaacttccattctctgctttgccaatttgtctgacagccctgggtcctgacagatgtgttttctctgtaagagggattttgacatcatttcctagaatctttttcttgaccaaaggcttgtgattggcccttggcaaattgtaagactaatgacatttgtgtgtgtgtgtgggtgtcttgtagctgtaaaaatcccatcttcaattacatctcttcactatgccaattctctatccttattcagtgggcaagcaaagatggttgttttgagtgacaggaagaaaaactggtgaactcttggcgtgaaacctgaataaccctcttccctgcttaaccacaaacagagaaacccacttagcatcatggcggggggacaactgagttgtcaaacatgtgcaggagaattaatgagaccgtttttatgtttttccttggggaagaggaaggacaggcagcattctcagacctggaggactttgaattaaaaatgaaagaggcgtgagaattcttttcagttttttcccattcaatcctattacacattttatgacccttggcttgggggcccaattttaagcttgccttggctaagaactagggactcaagaaattaaagactcctcttccccatcctcccaggggctcttaatttggtgcaggaaataggtacgtttaaataagccactttaatacaaagtaaactgtgcttaggactcagcacagtgcctgccccatcgtgggcactgtattagccgcacctcttcagagaaccagaagaaatgaaatttataaaagaaaaaagtgtaggaagaaatgtattgtaaggattggcttacctgattatgagggatgagaagtcccatgatataccatctgcaagccaaagaaccaggaaagccagtggtgtggttccagtccgagtctcaagtcccaagaaccaggggtgcttatgtctgagggcaggagaagatggatgccccagctcaagcagagagagcaaattcactcttcctctgtctttttgttctcaacagatcggatactacccacccacattggtgatagtaatcatctttgctcagtctactgattcaaatgctaatctcttccagaaacactgtcacggacacatccagaaataatgttttaccagctatctgggcaccacttggcctgatcaagttgacacataaaattaaccatcataggcacttaataaagttgtgtggaatgattgaatgtttgcaggaatggatggatggatggatgggtggatggatggatggatggatggatggatggatggatgaaggaatgaatgaatgaaggtccatgagaaagtgccagacacttgggtgtgtttttagtgaagtatattgttaggagttttacggagaattgggggttgatgtatgcaggacttcactgagtgaaagagaagataaaaaaagagataaggggtcatggaaaaaccttaagactcagatttgggggcccaattttaagcttgcctgcatccccacttcccttagaatactgtggtgggtagggcaacattctgcagtgatgctcaaacttgagcgtgcattggaatcacttgggaggtttcttaaaacccagattggccaggcgcagtgactcacacctgtaattccagcactttgggaggccaaggcaggcagatcacttgaggtcaggagttcgagatcagtctagccaacatggtgaaacccagtctctaataaaaatttaaaaattagccgggcatgatggtgggtacatataatcccagctacttgggaggctgaggtagaagaatctcttgaacccgggaaccggaggttgcagtgagccagggtcactccactgcactccagcctgggagacagagcaagattccatctaaaaaaaaaaaaaaaaacacccagattgtggggccccaaccacagagtttctgactcagtaagtttagggtggagcttgagaacctgcatttctggcaatttctcatgcgatggtgacgctgatggtccaggtaccacacattgagaaccaccagccaattggcttagaacaaggactctggattcaaacaacttgagcttagggttgccaggtaaaatacgctcagttaaagttgcatttcacagaaacaacaaataattttttagtataagttccatgtcagaggcatcctgtatttttacttgctatgtctggcaaccctgttgggtttaactctcagtgctgttactctggagccatgctgtttaaggcccatcatttggctctccgagtttcagtatcccccacttacaaaatgggggtggtaacaataccagctgtctcctaaagtaattatgacgatcaagtaatcgtataaaggatttcacacagagccttgcctgtagcaagcacgcaggaaatgtcagctgttattattcaccattatcctcaggtgagtaacttttggggtgaaaaaagcattataccgagtgttttttttttgaaaggattttatgattcagccttttaaattttaaactagggaatatttctcctctttgaaaaggtccttgaagctgccctctctcatttctttaatagtagattataaagaatggattggttgattgcatctaaaatctcctcttccaacaactcccaaccccactcagggccagatttgactgatctctgggtggtgtatctgggtgttaaatttctgaggggccagtaaaggcaggtcgctgggggtagggctgagtcctgcctctaggaaataggcacagctcctttcaaactgctgcttgctatgaacaaaaacagaatgagggtcaggcgtggtagccagtaatctgtaatcccagcattttgggatactgaggcagaaggatcatttaaggccagaagttcgagatctgtctgggcagcatagcgagaccctctctctacaaattaaaaattaaccaggcatggtggggtgcacctgcagtcccagctacttggggggctgaggtgggaggatcgcttgagcctaggagtttgagaccagccagggcaacataaggagactccatgtctacaaaaaaataaaaagtcaagccacacatggtaatgcatgccagtactcccacctactcaggaggctgaggcaggaggatcacttgagcccaggagttcgaggctacactgagctatgatcatgcagattgcagctgcacatcagcgtaggtgacagagtgagaccctctctttaaaaaaccaaaaacaacaacaacaacaaaaacaaacagaatgagagggagagggagagggagagggagagggagagggagagggagagggagaatgctttttaatatagaatcaattcagggctgattctatcctttggaattaaatttttcccctcaatatttcaaacttatgtccattttgaggtttgggatccccatttcccctgcacttcatggaatgccagcccattctggaagttggagagccagtgagggtcagtgtgaaatgttcatgggcaggctgagctgtgctgggggctaagcgttggtctgaaatgcctgaacatttctttataaagttgaccacatcagtatctttcaacctgtaggttgtgacctgtaaatggatcatgaaatcaatttgaagggtcataagtagtattcttgtttttcaaaaagaaatagaatgcaacacaatggaattgaaactgtcaggatgcaggccgggaatggtagctcatacctgtaaccccagcacattgggaggccaaggcgggtggatctactgaggtcaggagatcgagaccagcctgggcagaatggcgaaatcccatctaccaaaaatacaaaaaaattagccaggtgtggtggcgtatacctgtaatcccagctacccaggaggctgaggcaggagaatcgcttgaatctaggaggtggaggttgcagtgagcagagattgtgccactgcacattccagcctgggcaacagagcaagactccatctcaaaaaaaaagaaagaaagcaaagcaaagcaaagcaaatatcaggatacattgcagtgcacatagtaagggtaaatgttgtaaacttttgatacatatgatatgtatgataaatatgtaacatacactatttacaggtgtaataggtcatggaatatggtcaaaagaacgtggaagtcatgagagcaggtaatagctaaggccccttgcaattttgcaatatggtgtcagtaagatggtggtttttaagcaggggcaattttgcttttcaagggagatttggcaacatctggagacgtttttgatagtcacgactttgtggagaaatcgtgtgctaccggcgtctaatgggtagaggccaggggtgctgctaagtgtcttgcattgcacaggacagtcccccaccacagggaattacccggccccaaatgtcaatagtgtggacgttgagaaaccctgctctaagggtacgtgtggatagaatcacttaccagtagtagccttattactactaactaggatttacggagcacttactatatgcaggcatgcttctaagtgctcacattgatgaactcttttaatacttacaacaggtgggagataaaagtgtgtttccttcccccttttcagatgaggaaactgaggcataggatgatcaagggttgcccaaagttacaaagttagcagaattaggattccagtgcaggaattctggctttaattccttgaatcagcgttttatgcttccatagcacttcagtctccaaagcctttttttttcctgtagcaaaacacatgtaaaatttgccatttcaaccatttaaaaatgtgcgattcaatggcattaagtatattcacaatgtcgtgcaaacccgttcaacaccaccatcaatttcaaaatttttgccaccccaaacggaagccctgaaccagttaagcagtcattccacacattctttcctctcctcggcccctggtaacctcccatcttttctctgtgtctatgaatttgccgattctagatatttcatatgaatgaagttatgtgatctgtggtcttttgtatctggcttctttctcttagcataatgttttcaaggtttctacatgacgtagcctgtgtcataatttcattccgttttatggctgatttatattccattgtatggatagatcacattttgtttatccatgtgtctgttgatggacactttgtttgcttccacattttagctattgtgaataaaactgatgtgagcccaaagctttttttttttatactgaaggtggagaaggattgtatcactgaggacaggggagaaatccagattgttttggtgacagacactgttcttagtcatctcacatatattatctcatttgatcttcacagtaaccccacgaagctcccccatttttacagatgtgaagaacagagagggtgagtctcctgcccagggtcacacagcaaatcagggcacattactctttgtcacgaagaggagaagtgtgtgtatattatgcagcagaactctgagcagtggctgccttctagaacaggagctgaacttctgatttgcacagaaatctagataggcaaaattccctcaatactcatattgcactatttctaggtgctgtatttagacatgtatgaagaagcctcaattgagaataaagatagttctccttgtgcaagaaaaaaaaaactacttttaatctctgagattcagtgccatgactttcactcattcttgatttgttgaggcttccttcacagtcaatttattccctccgtctgcattgatgaagaacttactatgtgcaaggcactgctccagacatgcaatatggcagtgaacaggacagaccaagtccctgtccatgtggagtttatgttctagtgggggagacaggtaataaaccagtgagcaaacacacaagtggtccagacagaggtgagggttaagtattgcaccttcctcttgaaacatatctgttggctctaacgacgtccacaaggagatactgaaccctgaggctggagggtaaactcagcttcccaccctcaactcactctgttcccaggaatgaccaagtgtttatcatgatgaattgagcgtaacatcttcccatcatccttggggtccctattacagacagagacagagctgaaagctagattcattcatatctgactttttccactcacttttttttctctggagtggagtctatttaggaaaacaccttcaggggtcaaggtgatctcctatatcagaaatcagcagactttttcggtaatgagccagacagtacatagtttagtctctgggtcacacggtgtctgtggcgccttctcaactctgttattctaacacgaaagcagccagagactatcagtaaatgaatggatgtgtttgtgttccaattaaactttatgaaccctgaaatgaaatttcatatagtttttacctgtcagaaaatattcttaataattttttcccagctatttaaaaatgtaggaaaacatccttagctagcaggaggagggctggacttgacctacaggccatagatcatcgactgtgcctgtatcattcctcatcaatggtcctctggcatctgaatctttccttttttaactccagccaacagactgcatcctaaggcagattattctgctttcagaaaggtgctgtttttagaaagcatcaatcatgtattgagtcaaaatatgccttcttgtatcattcatccaacaaacactttgtaaagaaatttaaacatttcaactttataggatggaagtttggggatatacataaagttagagagaacagtgtaatgaccctctaggtgcccatcacccagtactgaccattatcagcgcgtggccaatcttgtctcatctccacctgccaccctgcatagattctttgaaaggaaatctcagatctcatattactctatcagcaaatacttccatacacatctctgagggataaggactaaaacattttaaggtgacctgattttaaaattaacagtaattccttaaaatcattaatgttcagccagtgtctaaacttccctgacttatgttctttgattgttaatttctttcaacccagatcaaaataagatctgggcattgcatttagtcagtaaatctcttaagtcttctttttaaataataggtttattgaagtgtaatttggcacacagtatttaaagtgtacaatttgataggctttgccttatgtttataaccatgaagccatcaacacgatcaagataacatttccgtcaccccaaaagtttctctgtagccttttgaaattcctccttcccacctctccccacctcacctcacctacctgctagccccatgctgtcagtaatttgctttctgtcattttagattagtttatactttctagaattttatataaatggaatcatataacaggtactgatttttatctgaccttcttttataattataattagtttgagattaatccatgttgttgggtatagatagcttattcctttgtattgttgagtaacattctgttggatggatataccacaatttatctgttcatctgttggtgaatatttggatcattcccagttttttgctattataagtaaggctgttagaagaatgaaaaaaaaataagccagagactggaagaaaattttgcaaagcatagatctaacaaaagacttatatccagagtatataaagaaccctcaaaattcaatgagaagaaattgaacaacctaattaaaaatgggcaaaagatttaaacagctacttcaccgaagaagatatacagatggcaaataagcacatgaaaatatacttagcatctttactttgggaaaatgcaaaataaaaccggaaataagataccactattaaaatggctacaatataaaacgctgtgtcgggcacagcggttcatgcctcaaatcccagcactttgggaggctgaggtgggaggatcgtttaagcccaggaattcgagatgaacctgggcagcacagtgagaccttgtctctacaaaaagcaaacaagattagcccagcacggtggtgcacacctgtagtcccagctacttgggaggctgaggtgggaagatcacttgagcttgggaggttgaggctgcagtgagcagagattgtgccactgcactctagcctgggtaacagagtgagaccttgtctcaaaaaacaaacaaacaaaaaaacaaaaaacaaaactgaccataccagatattggaaagatgaggagcaatgggacctctcatatactgctggtggggatgtaaaatgatacagctactttggagaccagtttggcagtttctcagagttaaataaacactgtggtaggcagaataatgtcccacctcccaaagaagtgcatgtgctaatccctgcaacctgtgaatatattacatagaaaaaggagctgggcacggtggctcacgcctgtaattccagcactttgggaagctgaggtgggcggatcacctgaggtcaggagttcgagacgagcctggccaacatggtgaaaccccgtctctactacaaatataaaaattagccgggcatggtgggatgtgcctgtagtcccagctactcgggagggtgaggcaggggaaatcgcttgaatccagaaggtggaggttgcagtgagccaagacggcaccactgcattccagcctgggcaacagagagagaccctgtctcaaaaacaaacaaacaaacaaaaagggacattgcagttgtgattaagttaaagattttgagatgggaagattatgtggattatctgtgtggtccaatgtaattataaatattcttataagaggatggcaggagggccagagaaagaaatatgaagatgctacattgttgactttgatgaggaaaaggggccatgagccaggaatgcaggtggcttctagaagctggaaaagacaagagaatgagtcttctctagagctttcaaaaggaatacaggtctgcctatgccttgattgcagcccagcgaaatgagttccaaatttctgacctttacaactgtagcatagtaaatttgtattgttttaagccattaagtttgtggtaatttgttacagcagcaacagcaaactgatacatattcctacatataatcctgccatctcatttctaattatttatccaggagaaatgaggacttacgtacattagcacataaatgcttctaaatctcttaatctgttagaggtccctctttctcatggatttctgccatttataacaaacatctgttgagtgtctactgtatccctgagcctactctttagagagatacagtaaataatactatttttctttctttcttgttttttgagacacggtcttcctctgttgcccaggttggagtgcagtggtaaaatcatggctcactaacagccttgacctcccaggctcaagtgatcctcctacctcagcctcctgaatagctcggattacagtcacgtgccatcacgcctggctaatttttgttttttttgtagagacggggtctcactatgttgcccagcctggtcttgaatgcctaggctcaagcggtctgcctgcctcagtctcccaaagtgctgggatcacaggcgtgagccatcacgtttggcctatttatctttctttatggcgtgttttttaggtggttcacacaccgtgaggttccttccctgacatctagtttaaacaatctctgttcttccacacagtctgagtgtgtgaaaattcctcttaagggactgtgatacagagaactgtacttagaaatgcaatgcgatttgcttagggtggttcaggatgttatgtgaacctctgttttttatcttcccaggatccttcaacatctctggacaaagtcatcccagctttaattgggagcaccatcttccttcagtttctagattatgtgactttgttgtgtctgtgactgacctcactccatgacaacagggcagtcacatgtctttggctggccaatcagggaacaccattgccctggccccaagagactggttcagtgatgggcacttggctcaagctggatcattgtagaaatccctgggctgtcaatcactcctcaacaggttgctgggtaagcacaacatcagagtaaagggaattaggtgatcctcaaagatgttcactcatgctggaaagacaagacaagttggcagcaaattcttctaaagggacacatatctagttttgtgagagaggcagtgtttctcatttggggacattttggagactcttggaaaaaccctggcaatatcaatgcttttgctcagctttttgagtggtgcatggagacacatggcctcagtgtatcagttggccgggctactggcaaggaattgggattggctttcagcttgttgcatgtgccctgcttagctttctaagcttgaacctgatccttccttacctatccaactgctactgtcactctttcctcccttaaatagaactcatctctctgctttatcaaatccacaaccctgcgaatccctgatcagctttgttttcttcactgagagctttctggcttcttcggtcttctaaccagattgcaattaaagacagaaatcatggcaaatacttatttcttactgtttcctgtttctaccctggtctttccaaccacattttaggggctgtatatcagatgtgcctcttgtttatatagagagtccggtagtcatttgataaatgtctgttgcgtgctgagattcgagatggacaaggtccctgccttcgtgaaggttgcaatatagtgggtgggaaaatacaataaacaagtaaatagatactatgtaaggatgaaaacaagaacaagatcagataatgggcaatgggaagagaggaaaccctaataaggtagccaaaggaggcttctttgaaaagatggcatttgagtagacacttgaatggactgactggcttctctccctctttttggtgttagcttggtggcttgtgataaaaacaatggacagtagaatttttaacttccttgctttctgtgcttttttgccaaatctcttccaaattgcctgaaatgatccaacagaccacagtagacacagtaagagagcccctcaagaattcctacatcctgatattcatgctccatggaatccctacaccttgagtgtgggctggatttattggcttacttcttgcaaatgaaatatggcagaagggaggtcaggtgtggtggctcacgtctgtaatcccagcagtctgggaggccgaggcaagtggatcacctgaggtcaggagtttgagatcagcctggccgacatagtgaaaccccgtttctactaaaaatacaaaaattagctgggtgtagtggtgggtgcctgtaatcccagctactcgggaggatgaggcaggagaatcacttgaacccaggaggcagatgttgcagtgagtcaagatcatgccattgcactccaacctgggcaacaagagtaaaactccacctcaaaaaaaaaaaaaaaaaaatggcggaagggatgagctgtcacttcaacgtttacatcataaaatgaccatggcttctaccttaggtattccctgtcttgctttctcttagatcactcactccaggtgaagccagattccatgtcatgaggcaggtctgtgaagagacccacgtggcaggaacagaggcctgtggcctgcccaaatccacctgcgtggctttgaaagtgaattctctcaagttgtgtcctcaagcgaaatttcggccctgacaactgcaactgcctaagtggccttgagccagaggcacccagccaagctgctcctaaggtttcagacccacagaaatagtgagataataaatgtttgtattttacaccattacattttggggtaatttgctacacagcaatagataactactacacagtcaaactggaatgatcatctatgggtctgtatgggtttgcctctctctactgagtggggcagatggccatggtatccagaaaaatactcttccttagataaaataggcatcccaaggccttttcacactgggtcataaatgtacatttagtggatcatttccatcactaaaatgtaagatccacaaggaaacttgcatacttgtaataactcatatactgtaagcccgtgtccagcatgtagttaagcattgtatgttcaccgacttcctttatctttcgaacaatcctatgataaatgtattattataatcgtcattttgcagatgtgaaactgaggcggagaagaattaagttgcccaaagtgatgtcatgtgtaaatggaggaggcaggatttgaacccaggcagtttggcttcggagttcttaataaatatttgggttggagtaaatgagggagtaaaactgtgggatgactcctgtccttcatttcttcattggtgttttcgtaaccccttgtgtggtatttgttgtcgacatcttgctgtctaaaatatattccgaaagcatcctgttcctttttcatctcgctgttttctttgctaagcccttcacaggaggctgggcctttctctctgtgttgggatcttttatattttaagatattctcttcgccaagcatgttgacatgtgagttgcaagcaaagcctctgagaagcaaaatgttgaacaattatcagttgaagacatcatgtcacaatgaacttctctttaaacaaataaaaaagtcccatagcaaactccttttatctgaggatctccaggggcccctctgacactggattgtcacaccgagacatttcaaacacagactctcatcatttagtctggttgctggggccccagacttctttagaatagataatgcagcttcattacggttctgtgtgaatgtgcctggaaaaggatcattgcatttcttttaaaaagcgttggcattttttttttccttccagccacttaattgggattgtgatgtgaaaaaagaagcatagaacaaaacttccaataaaaaaatttggactcagtctccataatgtcatccaggcttgctttggccttgatgaattcagcacttcagagggtatgtcaacacaataaattttatgccctcaataaaacttgtgagtgagctcagtgagaaattccaaggtctgggaagacaattaacgtttgaaatatatattgagttgtgtactgcgacattttatgtggccacagagctgtacccgatgtcacaggggaaaaatttccctaggaaatgcaaggtttgcttttcaaataacattgacatgtcagattcctccccaaatacagaggaatgtaagaaatgactaccaatgaaaatccagtgacattctctgaccacattgatgtgattctccttgttttccatttcaactggcagttgtcttcagagtgtatctgttgtcaacatctcagcaccttaattttattagactatttatatgactattctttgtagttctgtgtgcatgggggtgtcttattaattgatttgactggagttcaagccccagccctaccttttagtcaatgtatgatgttatacaaattgtattacctctctggactttattttctgttgtgagaattacagtcatgcacagcataacaacgtttcagtcagtgatggaccacatggacaacggtggtcccacaagattataatggggctgaaaaggccgggtgtagtggccaagcctgtaatcccagcagtttgggaggctgaggtgggcagatcgcttgaggtcaggagttcgagaccagcctggccaacaatggcaaaaccctgtctctactaaatatacaaaaattagccaggggtggtgggcacatgcttgtcccagctactttagaggctgaggtgggacaattgcttgaatctgggaagcagaggttgtagagtgagccaagattgcaccactgcactccagcctgggcaacagagctgagactccatctcaaaaagaaaaagaaaaaaaaaaatggggctgaaaagttcctatcacctagtgatgtcatacatagccatggtaatgcaacacattactcacgtgtttgtggtgatgctagtgttaataaacctactttgctgccacttttataaaagtctagcacatacaattacgtacagtacagagtacttgatgatagtaaaagacaatgttactggtttatgtatttaccatcctatacttttatggttattttagaatatactcctatgtatttaaaaaaaaaaaactgtaaaacagactcaggtaggtgctgcaagaggtattccagaagaaggcgttgttgtcataggagacggcaggtctccatgtcatggagatgaacacatgcctgttattgcccctgaagaccttccagtgggacaagatatggaggtggaaggcagtgattgtgatgatcctgacccagggtaggcccaggctaatgcttctctttgtgccttaatttttaacacaaaagtttaaaaagagaaaaaaaatacattttaaaagtagaaaaaaaatatagaataaggagatatttttatacaactgtacaatgtgtttatgttttaagctaggtgttattacaagagtcaaaaagttaaaaaaattagtttataaagtaaaaaagttacagtaagctaagattaatttgttattggggtaataattttttttcttttgagacaatgtctcactttgtcacccaagctggagtgcaacggtgtgatctcagctcactgcaacctctgcatcccaggctcaaacaatccccctgcctcagccttccaagcagctgggattacaggcatgcaccaccatgcctggctaatttttgtattttttgtagagatggggttttgccatgttggccaggctggtctcgaactccgggactaaagaaattcacccgcttcagcctcccaaagtgctcacaggcatgagccaccatgcgcagctagaaataactttttaaaaaataaatgtagtataactcaagtgtacagtgtttatcaagtctacagtagtgtacagtaatgtcctaggccttcacattcactcaccactcactcactgactcacccagagcaacttccagtggtataggctccattcgtggtaagtaccctgttggggtgtacctttttaatcttttatactgtatttttactatagcttttctatgtttaggtaaacaaatgcttatcactgtgttacaattgcctgcagtattcagtacggtaatatgctgtacaggtttgcaacccaggagcaataggctatactatatagtttaggtatgtagtaggctataccttccaggctcatgtaagtatactctgtgatgtttacacattgacaaaactgcctaataatgcattttccagaatgtattcttgtcattaagctacgaatgactataaatgcaacaacaggttatcatatagtctgttaattataatttaagaagtcgctatcatttctttgtgtaagattaagctctctttgaggagggtgctaaggcacagattgtgagcagataaaaaaatgtcagttaacatgtattagtcagttattgctgcctcaatgctgtgtgacaaataacctcagaatttcattggtttacaacaatattaattaaatagtatatttgtcatataaatttacctacttgtttatttttgctcataggcctgtgggttagtcaatacagctcagcttcaggctgcaaattgggtttaggtctactccctgtgtaccacccggggtgtgctctttcatgggcaatgacagtggtgccagaacagcaatcagaaacatgactgggcgcggtggcgcatccctgtaatcccagcactttgggaggccgacaagggtggatcacctgaggtcaagagttcgagactcgcctggccaacatggtgaaaccccgtctctactaaaaatacaaaaatgagccaggtaaggtggtgcatgcctatagttccagctacttgggaggctgaggcagaagaatcacttgaacccgggaggcggaggttgcagtgagctgagatcgtgccactgcactgcagcctgggtgacaaggcaagactccatctcaaaaaagaaataaaagagaagaaacacaggatgcctcttacgttgtaaactctaacccacactttgacaccttttcctacatactattggccaaagcaagtcacatcgtcaaaaccaatactagtggggcagagaagtatagtccatttagcgtaagagacaagacagatttggggaaaaataatgtcacctaccatgcaaagtaagaagaggtaaagaatctgagaccacttatatatacaaaaggtacccaagaaacatacagttttctctcttttggattcatatctcaaatcttttgaattgaccttattttctacaatccaagtaaagattgagttctttcttttccttctatttgacaaaatcatagatttgttccaccagtgactcatttttcctttcagaaaatcatgtactttttattcaaggtctccagaaactctttggctgaaggtgaaatgtgtattgatattgactcatctttaaatgtcaatgaccagtcaagataattaaggagttaagtattggttgcagagaaaagggaacgcttatacactgttagggggagtgtaaattagttcaacccttgtggaaagcagtgtggtaattcctcaaagagctaaaagcagaactaccatttgacccagaaatgccactactggatatatacccaaagtaatagaaatggttctatcatagagacacaggcacatatatgttcattgcagcagtagtcacaatagcaaagacgtggaatcaacctaaatgcccatcaatggtagactggataaagaaaatgtggtacatatccaccacagaatattatgcagctataaaaaagaatgagatcatgctctttgcaggaacatggatggagctggaggccattatccttagcaagtgatgtgggaacagaaaaccaaataccacatgttctcacgtgtaagtgggagctaaatgatgagaacacaaggacacacagagggaaagaatagacactaggcctacttgagggtgaagggttaggggagggagaagataagaaaaaataactattgcatatcaggcttagtacctgggtgaccaaataatgtgtacaataatcccctgtgacatgagtttacctatgtaacaaaactgcacatgtacccctgaatctaaaagaaacgttaaaagagtaaagtgttggccaggtacagtggctcacgcctgtaatcccagcactttcggaggccgaggcggatggatcacgaggtcaggagatcgagagcatcctggctaacacggtgaaaccccgtctctactaaaaatacaaaaaattagccgggcttggtggcgggtgcctgtagtcccagctactcgggaggctgaggcaggagaatggcgtgaacccgggaggcggagcttgcagtgagccgagatcgcaccactgcactccagcctgggcgaaagagcgagactccatctcaaaaaaaaaaaaaaaaagaaaaaaaaagagttaagtgtttactcatctattcaaatcaagtgacactatggtgtgcacgagactggaaatcaggaagaagtacaagattctagtctcagctctgtcactaagtgtggacaagacagtgatgttctctgggggtaatctacaagaaaaaaggctgaggaagccacagggcaaatcatttaatgacgttaactattttcagtaatctctcaatgcagaagtcatcgtctaaataagcattcctttccaaatgcagtctagctattttgcctaaaagttggcagatgtgacttgccccagggtagagaacatcttaagaaagatattttaaatgtggtgtttaaacaacctataacaattatgcaggggttttttaagttcatataacaattctactgctttttgctcattcattgtttctgtttttctcattgttgatccagtaatttcacttttaaggaaatagagatgaggaaaaaggtttatgtacaaaaatgttcattgtggtacttaaaaaaattaaagtaaaaaattggacagaacttaaatgtctaatcataagggactgattgagtaaattattgtaaatctatttaatggactataatgcagatgttaaaatcatgttttaaaccattttaatgacttgacaacgttcttatggtataatattagatgaaatatgtaaaataagaaaagcataatattttatgaccatcaattctttaaaaatgcaataataagtttgtaaggaaattcagaggaacaggaatggtgattatctcaggattgtgacattctaagtactttgcatgttctttacatttttctacgttttctatttttgacaacaaacattattactttttttgggggggggggcgacagagcaagactctgtcttgctggagtgcaatggcaggatctcggctcactgtaacctctgcctcccaggttcaagtgattcttctgtctcagcctcccaagtagctgggattacaggcacatgccaacacgcctggctaatttttgtattttttgttagagacatgttggccaggctggtcttgaactcctggcctcaagtgatccacccgcctcggcctcccaaagtgctgggattacagttgtgagccaccacaccagtctatttttcatttttgttaaagtaatacatttacatacacacataggcatgccctaccgtttttacattctgggttcaggattcagggtgtcagaggaacaggaattccagtggaggtaagctctgatctggggagagactctggggacacgggtgtgctcattcctggatttggggtcatcctgtttggatggctcccagagggaattaagaagcctttggcagaaccacttctgatcgagacagacaggcagtagtctttgaacccaagcactggcttacaacttggacttgatgaaggcattacaaaatcactttatattgctcattctttccagcaacttctctgtgaattctagttggaggaaaaaacaaacaaacaaaaaacaaacacagactttagacacaagacgttttgcagcctccagatctgctcacactttgccaccggtgtctgtaggggataaagtcaactctgcagggttggcaaatggcaagatttgcatacacccagaaatcaccattgtgatcttcgtttagacagcagtgcccccagaacccgcctgctagccctattctcccaatgacatataggagagacttccaaagaggtttgggtctgaggtcacaagtggttttcatactgaaagtaattttggtggaaaggagacggcttcaaaactcctgatgctctttattgtcttcaaacagcttaaacagaatgtgcaggaaatataagctcctccctttaaaacactgaccttttttcacattagtttccctggaagtttgaacaaagaatcagtgggtaaagaaaatgatttgggatcccagttgtacagcgggcattttttgaagtgttttatcatcttgccagagtggatatgcttggctggagttagagcccgccagtgaggatctcaagctcaagaactcaacactcctgcctttctagggtttgatttactctaacacatacgcactgccaaggtcattgccaccctttagaggatgatgcgacaatatggtgtttaagacaaacttgcaaataggttaccagcccatggaagaatttatttttatttttattttttaaccagactcaacctggtttgtttgtttgtttgtttgtttgttttgagacggagtttcgctcttgttgcccaggctggagtgcgatagtgcgatcccctttcaccgaaacgtccacctcctgggctcaagcgattctcctgcctcagcctcctgagtagctgggattacaggcatgcaccactgtgcctggctaattttgttacttttagtagagatggggtttctccatgttggtcaggctggtctcgaactcccgacctcagatgacccaactgccttggcctcccaaagtgctgggagtacaggcgtgagccactgcacacagcccgccttaacctgtttttaagataaacccaggtacaaacatgcaataaagcaacattcctttgtttcctcaacgtgaagctcagttgtgacaaggtgctctattgttaccacaaaggggtcccgatccagattccgacaaagggttcttggatctcacacaagaaggaatttggggcaagtccatagagtgaagtgaaagaaattttattaagaaagtatagaacaggttgggagcggtggctcacacctgtaatcccagcattttgggagactgaggagggtggatcacttgaggtcaggagttcgagaccagcctggtcaacatggtgaaaccctgtctctactaaaaatactaaaattagccaagcatggtggcaggtgtttgtaatcccagctactcaggaggctgaggcaggagaattgcttgaacccgggaggcagaggttgcggtgagccgggatcgcaccatcgcaccccagcctgggcaacaaaagtgaaactctgtctcaaaaaaaaaaaaagtaagtaagtaattaaagaaccaagagaatggctactgcataggcagaatagtgacgtgggctattcaactgagtatacgaatggtaatttcttgattatatactaaacaaggggtggattattcatgagttttgcaggaaagggacaggaaattcatggaagtgaggtttcctccctttttagacgacatagggtaacttctagacattgcatggcttttgtaaactgccatgagactggtgggagtgtcttttagcatgcaaatgcattctaattagtgtgtaatgagcaacgaggatgacctgaggtcacttttgttgccatcttggttttggtgggttttggccagcttctttattggatcttgttttatcagcagggtctttatgacctgtatcttgtgataccagtcctgccgacctatctcgtcctgtggctaagaatgcctaacctcctgggaatgtaatccagtaggtctcagccttgttttacccagcgcctattcaagatggagtcgctcaggttcaaacacttctgggaagatcacacattttaactaggtccctgttgtgcactgaattacttaggagatcatcaggggttcctaagatggtctcaggtggtagaaacttatgagcgagaggataaactagaagagagtaaaaaatattactctgtggtgggagaacagggaattagggtaacggaggttcagcaggtgcagccagttcacataagcaaaagaacagcaggtccagccagtttgcataagcaaaaaaacagcaggtgcagcacataggccacatccttgctcccatgataacaagccacttcagcttcccattggtcacgggccagtccttcaaagggtgtaaccaactggagacctctaaaaggcacctaggggtgttgccaagttcttttggctttataaaaactcttgggaggattgcagtaagcaggcacttgagttgcttgttcgagcctgctctctgtgagttgtgttcaatatctctgcccatcgtgtggcattttgttcaattccttgtccaatacgccaagaacctggacaactcacgattaggaccttctgataacatattttggcgaaccagtcaggaggtaagacaatattttgggactttttaatattcctcttctctgagtggggcgagggactctcatttcatgtatgaattctttatgcataagagcgtggaattttccattgtttgtagggataaaccccataataatttcacagtacattgcaagattgcttgtttcatgagtttcaggccgaagaagcttatttcacttggtgagacgcaaagagctgagcgttgcatccgttgaccaagggaatcatagaccattccattgcctatggaggaaaaacatcctcagagatgcctgaccccctagggtcagaggcatcagcaacagataggccctccttaggccagatcactatgggaaacaatattcagacgagttttcgctagtaccaatagacgcctttgctggcttggttgaagcctaccctaacagaacagagaaggctaagaaggttataaaggttctcttgaaggaaatcatctcctggtttggattaccccaaagcctccaccacaaagtctccaaagtaataacagcccatcttttatctcccaaataactcaagcggttgctaaggctgttggaatacaagctacttcaggccctgattgactgcgggccaggtctccacttcagcctctgattggtggcaggccaagccttcatggggtgtagccaactggaggcctctaaagggaccgaggggtgttgctgggctctggcttcatgaaaactctaaggaggctcttgagccgcttgctcaagccccctcccactctgtgagctgtcttcaataaatctgtgctttcatcactccattctgctgcgttgtcctccattgcttcgttcttttgttactgtctgtgttgttcaatacgccaagaacctggacaactcgatccagtaacccttcgtactactatctccattactaccatgataactactgttgctgctgcttctattttattactctgactgccgctacgttactactattactacctttagtattgctgctgctgctgctactattactattattgccaccactacttttggtattactaccactaccgtgatggttactgctcttactgccgcggctaccagcagtcgccgttttatttttaacacctcctgagtgcacatcagtttatatgtgtgaagtcacttaatacaaatgccggccaggcgcggtggctcgcgcctgtaatcccagcacgttgggaggccgaggcgggcagatcacctgaggtcgggagttcaagaccagcctggccaacatggtgaaaaccccgtctctactaaaaatacagaaattaggcgggcgtgatggcacgcgcctgtaatcccagctacttgggagctgaggcaggagaatcgcctgaatcccggaggtggaggttgcagtgagccaagatggcgccactgtactccagcctgggcaacagagggagactctgtctccaaaaaaaaaaaaaaaaaaaaaaacctgccaaccagtgtgaggaatactaactctgttgttcagatgaagatcttgaggctcaaacattatggtaacttgtttaatatcacccagtgagtgacagaactggggtgtgaagccagatttctgactctatttctcaaccaggatgctctactgggggtggcggtggggagagaagaaaaccatagcagacgattcacctgctgaatggctgtaattcccatgtgaggagatatgaatagtgtgaaatccaacaaggagacccttgttataaggatgcaggtacagggcgccctccccttctaagcttcctggctagatctcttgctttttctctcatgcattcacacttagatatacacacagcatatctttgagcatacaatttcacttagctgacctattttattttaaagaggaaatgagctaatgccctagatttcagagaagactgacatatccccgtttatctttctgctcactgctgttattctaaatcccaaacctaagtcgacaggttttcttaataggctagggtaaaggaaacctgggggcttctctctgccttcccctctccttccccatcctagcctcaacatttactcattatccatttgctgccaaacagagctcaaaaaagggagatctgctaattatttcatttgataaacacatggattgagtgcctaataatagctaatactttttgtgctttaaccataagctaggcctttgcacatataatgcatttcattcttacaatggccctatgagatgagaccattatcatccctttagagaggccagacaatgaaatctcaggttaagcaactttcccaaggtccctcaactttagcagaattagggcttcactacattgtgcaaaataatgatttggaaacagtttcatgccatgggagataatatacagataaataaggctcaactccttgtgtcaaagatgctgaaagcatggttatggctaaagatggggaaacaagcaaacataagcttgaacaaaggacaagggtggactagcaggttgggggaggagtaagaaaaagggctgaatctgggctgcataggaaactaaccagcttcgagaccctaacttgtatagtgggtttcagtgttgaagggccagtgagtttgaggcagaaataggcaggacagaggggcctgcagactgattgtatacaatctgctgctgcagtattcacaataccaaaggcaggaatcaacccaggtgcccatcaatggtagactggataaagaaaatgtggtacatatacatcatggaatactatgcagccatgaaaaagaacaaaatcatattctttgcagcaacataaatacagctggaggccattctcctgaatgaaataacacaaacggaaaacacaaaatactgcatgttctgacttataagtgggagctaaatcttgggtacccacagaaataaaaatgagaatagacactggtgactccaaaaggaggaaaagaggggggcaaaggctgagaaacttattaggtactatgttcactatctgggtgatgggattaatagaggcccaaacctcagccttgcacaatatacccatgtaacaaacttgtacgtgtaccccctgaatctaaaatcaaaataataaaaactgctacagtttgaaatgggccagctccaagtctcaccctgggtgctatattttcttcaatataatgaagtgctgcctgtacccatgtgcaaaggagaagtaaagggcaacagctctttgtcttagcccagaaacctcaggatataagccctgggaggagacagtctttagtaagaagaccctcacagaggtctgatgagctacttcaaattatacctggcctgtgcttgcttttgaggtttgaataagagttaattggctgggtgtggtgcctcacacctgtaatcctagcactttgggaggctgaggggggcagatcacctgaggtcagaagttcaagaccagcctggccaacttggtgaaaccctgtctctactaaaaatacaaaaattagctgggtgtggtggtgggtttctgtaatcccagctactcaagaggctgaggcacaagaatcgcttgaacctgggaggtggagattacagtgagccaagatcccaccactgcactccagcctggaggacaaagctagactccgtctcaaaaaagttaagtcaaaagggaaagttgcatcaggcagaagaaacagattaactccatgccccattatttcccctatgtcagggatggagggaatagtacctttctcttcttgtcttcctatacctatctgccttctcttaccctctctacctattcctttcttcactgcttttggagggaatggaatgccagctaggtttgtttgagacattgtttaccagtgggtggcgatgctactgaaaaactgggggtttggtctgggtcctgttgctcaccacacagaaagcccatcactgagatgaccagtattgctaaggacgaaagctttgatccagtgccaaggagatgggaactcattctcaaacccatctccctgaccaatgaaaactaaggggtttatatagcagggaagaaatgtaacaatgtgtgaaaaagcagttatagtgaggggcaaggaagcaatctcatgaatgagggatcccacattttgctgtctgaatgtggtgatctggtgagtttcagttctttaatagttttttaaaaagaggcctgaaggtcttttcctgaggaagaaactcagataaaagaaatgtaagagtggggcctggtggctcatgccagtaatctcagcactttgggaggccaaggtgggtggatcacctgaggtcaggagtttgataccagcctggccaacatggcaaatcccacctctcgcttgaacctgggaggcagaggttgcagtgagctgagattgcgccaccgcactccagcctgggtgacagagtgagaccctgtctcagaaaacaacaaatgtaagtttcaagctttaagaacagaaggatcaatttctgtgtttatccaaaaaaaactagttgactattgggtcagtttcagtgatgttcataaaaagctcagacctaacccttttcattcccctccctctctggtttttctcctacaccatctggccagctcccaaactaaggtccttattgtaccctggccacgaaaagcctgagcgtgaagatcattgagtgtgagggcatcttgcagccgcatagaaggtagtggggatccaagtgcaggatttgggctgaggtggggcctccagacccttgcagtaagctccaactgagccatgtcagagctctgcactggggtcaccaggtcaagctgttgataaaatggtgctttgatgttttcctgcaaaccttccatatccagtccccttgggaacattcagggtggccaggatgactgttgacagcacatgaaaactttcccttgatttttattttattttttattttattttaagacagagtctcttgctctgtcaccaaggctggagtgcaatggtgcgatctcggctcactgcaacctccacctcctggattcaagtgattctcctgcctcagcctcctgagtagctgggattagaggcacctgccaccatgcctagcttatatatatatatatatatatatatatacacgtgtgtgtgtatatatatatatatatacacacacacacacacgtatatatatgtgtacatatatatatatatacacgtgtatatatatatatatatatatatatatattttttagtagatatagggtttcagcatgttggtcaggctggtcttgaactcctgacctcaggtgatccacccacctcagcctcccagagtgctgggattacaggtgccagccaccatgcctagttacgttcccttgatttttaactttcagcatcttcccatccttgtatcttttcttaatcttctgggtcattctctcttcctcattatccatcaagattcagctcatctgctgttctttttccaattccctctatgaaaaaaaaaatgagaaatcccctcctcttgcctgtaagctctaatggcactgttgtagctttttgtttctgtcattgccttgactggtttgtgagcttcctgagaaaagattttgtgtatctgattcatctgggggtgtccagtgcttagtgaattgcctgtcattaaataattcattcattaaacaaaaaatgtaaggggtgcctctatgtgccagatgctatgttagagtctgggatacattaataagttccctgtcccaagaaacttggagtctagtgtgggagagaggcatcagtaaaataatcacacaaatacatttaaactgacacctgaggtacataagcctttgaaagcacatgggaggggactagagcttgttggaaaggtcagtgaagcctcaggaggaagtaatgttagagctgagatctgcagggagagtggccctaaccaggtgaacattccaggtagaagaaacatggtgtaaagccccgggctggagatgagtacagcatgctaggggaagtgagagaaagctcactgtagccaaagcaaaaggggctagagtcaaagagagacaaggaagtagtgcttctgtgtctcagaagctcagaattgatgagccgtggctaaaagatgggtcttcatcccacaattgtgtgctcggcacaacataaggggctccctgaatctcctcagattcctgaatgctggaggctttggtcttccacacagataaactggcccctttctgccctcatggcatgtgcattaatgatgtgggtgtggatcagtgtttttacaagttggatcacccggaccaccctgggatgcagcggaagatgtgacagagaaaagtcgatcatgagggcgtctttgtgtagcctgttccaggagagaaggaaatacaatccagaactggaatgtctttcaatttccataagcaaatggaaaggatcttaattgagccaggatatcttcagtgctgtgcctgttttcatgatgctgttctctttcctggatctctgcccatgagtgtagggtgttctgtctggcagagaaagcatctcatacaaggagccctcatacaagctacataaaatctcagtggtctcagagctttagagtaaaatgggagaggaagatagacattaaagtaatgatatccaaataattatttaaaattgcatttggcataaacactattacttattttttgagagatggagtctcgctctgtcacccaggctggaatgcagtagcatgatctaggctcactgcaacctctgcctgcagggttcaagtgattctcctacctcagcctcctgagtagctgggattacaggcacccaccatcacgcctggctaatttctgtatttttagtagaaacgaggtttcattatgttggccaggctggtcttgaactcctgacctcaagtgatccacccacctcggcctcccaaaatgctgggattacaggcgtgagccactgtgcctggccatgtttggcataaatattataagaaagaagtacagggcactgagacatatagcccagtctggtctcggtgtctgggtagagtgatgccattttctgcaacaggaaacccagaaggatgaccaggtttggagcacaggatcagatccctgcccatgagcactgggttttctgtctggcagagaagggaacccatacagggggccctctctttggggcaaactgcccctacctcccatctagatattttatgaagagctctagttactgcttccaatctaatatcacctctgcaagaagaggttgagaaagagggaggaaccaaggatgacttccttgtttagggccaagtgactaggtggatgttaatggcataaacacaagaagaggtttaggggagaaaccaataagctcaatttttgtcttgatttgtttgaggagctgaagaacatccagttggatacccaaaaggtagctggagatcggagcctgggcttgagaaagttgggtgcttgaagactcagaaatgtttgagcaactttgtctaggaaacctttctcttcttggaaacagccaatttcccatctttaaaatctccctggaagataggtagaaatacctagtaccagccgggtacagtggctcccagctataatcccagcactttggaaggctgaggcaggtgaatcacctgaagtcaggagttcaagaccagcctggccaatatggcaaaaccccgtctctactaaaaatagaaaaattagccaggtgtggtggcgggcgcctgtagtgccagctagttgggaggctgaggcaggagaatcacttggcggaggttgcagtgagccaagatggcaccactgcactccagcctgggccacagagtgactctgtctcaaaaaaaaaaaaaaaaaaaaaaattcctagaatacagcccacagctccaaattacatttttaggcagttttcacaccatcctaaagaaaaagtcaggcagcctagacaaaggtattcctagctgcccacacaatccttctttaccttcttctgctatgtcatcaagccaagcagcacaattatttttctttcatatcatcatggatttcaatttttgtaacttctttaaaatttctaatagagctctttcatgtatccattcattcattcaatgctgtgtgccagtcattgaagaaaactacacaaaatctcagtggccttagagcttagagtcaagtggaagaggcagacagacattaaactaatgatatccaaataattattttaaattggcattgtcataaatattataggaaagaagtacagggcactgggggatgtagcccagcttggtctcaggtcttggatagagaatgatcagtttgctgggatgggaaattcaggaggaagaccaggtttgggtgtagaggggctttaaaacggtaaataagactcaaacactagccgggcacagtggctcacacctgtaatcccagcactttggaaggccgaggcaggcagatcatttgaggtcagcagttcaagactagcctggccaacatagcaaaaccccacctgtactaaaaatacaaaaaattagccagttgtggtggtgcacgcctagaatcccagctactctggaggttgaggcaaatcaaacacctgtggaactcactatgtgcactgggcaccattctaagcaggtttcaaccatccgctcatataatccttacagcgatcttatgaaggagggaccagcattatccttattttacagatggaggcgccaaaggggctaacatgtttttccaagtctccacaattaacaagagacagagccaggatatcaaatccagacagactgccagaatccaccctctctaccactgtacatgatacaggctctctctgggggacttacctagatgtgttcatttgaagattctggtgacaattggataaacactttccttatcattttaaaccgtttgagctgggatttctgttatttgctggcaacagatacaaatgtgaacggacgtctgaagttgtaaaattcaagagagaaggctgggctgggttcaatctaaggaaaaccttcacgttttacctccggcaatgcattctgggctatcctcttctcagtagtctttcatcttgaaaaggtttccttgaactgtagcctcttctgaaggacaaagacatttagggcatgatttttttacaaattaaatcgagactgggttcagtggttcacacttgtggtcctagcactttgggaggctgagattgaaggatcccttgaggccaggagttcgagactagcctgggcagcataatgagaccctgtctgtacaaaaaattaaaaattaggtgcggtggctcacgcctgtgatccctattacttaggaggctaaggtaggaggatcacttgagcccaggagttcacagctgcattgggccagggttgagccactgcactccagacttggcaacagagagaccctgtcttaaataaaatccaaaaaaaagcaactgcctactatggcggtaataccatccattcacagagtcctgtcttcatcttcccatccatacacagatatgtactttttgtttttttttttttttttttggagacagagcctcattctgtcacctaggctggagtgcaatggtgtgatctcagctcactgcaacctctaacctctgcctcccgggttcaagcaattctcttgcctcagcctcctgagtagctgggatcacaggcatgtgccaccaagcccggctaatttttgtatttttagtagagatggggtttcaccatgttggtcaggctagtctcaaactcctgaccttgtgatctgctctccttggcctcctgaagtgctgggattacaagcgtgagccaccgtgcctggcccagacacgtacatgttaagacccctgaaacaactttatgtacaagctaagtttgacacggtgatggatgtgaaacctggcaagtctgaaaggcaggaaaagccagcagagcggaaactgcttgcagcgtaacagaagcaggaagcttggtctgcctgtcttgggcatctcacgcctcacttgccttgttgcaaatatcgtaactctaccttgttcaagatccactaagactgattaaaaccgtttaaaatggctcttgttgacaagatttactatagaacatcttaatgactaaacaaaattatggtgtaattttacttgattaaagacaaaactaaaacctgtgcaatctccagtgtatgtgttaagatagcaacttaaaaacatctttaaagaatttagagcctggctcctgctggagagaaatgaaaatgggaatgtgggtattgttcatgggtttccttccccttacggcagcttcctgtgtggtttttgtttctttcatccctccgctggctctgtgtgcttttttccaattgtctagagagctagaaggtaatgactgtaaaaaaccaacgctacttgcaagcagggttgtatctctagatgttctctggacttcactccgtatctgacttcttatatgtgtttatcagtctcctgttcaaattccttctgtggctccagtcccaagcatcccctaatatcacaacacaacctgtttataagataaagctatgagtttattgcttactgcagtaaaaaaaaggacaccacctcatgcctcagtagggatggtaaggtcagatttttttttttttgggggggacggagtctcgctgtgttgcccaggctggagtgcagtggcacaatctcggctcactgcaagctccgcctcccgggttcacgccattctcctgcctcagtctccggagcagctgggactacagacgcccgccaccatgcctggctaattttttgtattttttagtagagacggggtttcactgtgttagccaggatggtctcgatctcctgaccttgtgatctgcctgccttggcctcccagagtgctgggattacaggcgtgagccaccgcgcccggccagggtgagaatttaatgagaatcggaagctcaacggaagacagggtcttccaaagtgggggcttgatgaaggatcaggtagagagcttgtcgtaacaacccaggattggtgcacacaccaagacgtagattttgaaaaaagggattaaagatgtttagagtatcaattattgatgtattccatggaggagctgatcttttgcagattcttaaaatgaacaccaattcctctacctggcagatgactgatggaaaaagaaagtcgtgctaatgaagacagaggaatagcacgaagtcatgttcatgtggacagaaaagtgctgttttttttttcttttttttgagacggagtctcactttgttgcccaggctggagggcagtggcgcgatcttggctcactgcaagctcttcctcctgggttcatgccattctcctgcctcagcttcccaagtagctgggactacaggtgcccgccaccacgcccagctaatttttttgtgtttttagtagagatggggtttcaccgtgttagccaggatggtctcgatctcctgaccttgtgatccgcctgcctgggcctcccaaagtgctgggattacaggcgtgagccaccgcgaccggcctaagaaggtgctgtttttgttctcagtgtccaggcagagagtgaggcattaatagatggtttccattcttactctccatggatgaagttgagggcgttggacgtattcccagggtcacatgtgatctgtcctctgcctttccatttccatcgcgtctccatctcagcttgtactctgtgatccagctctactgacttgcttttaacttcttgttgattcccaccccaggagcttagcatgggctgtagctatgcctggaatgccatttctccttcctattatttgcctagccaactctttttatatggcttaaacgtcacctcttcaggaaagtctcactgatttccaatctaaaggttggttcccccattctcaattcttttgagaggaaatgaactgaacccctttccacattgcttatgttttcttcagagaacttatcataatagtaactaaatggcaattttggaatcggttattttttatgcttgcctctgtctgctgctcactgctgtatgcctagggcttagaagagtgatttgcagctaatggatcctcaatagacatttgcagaatagatgattttgtgaatatggactgcgtctcctttgattgatgggaaaagcttttgttccattgaagttgagtgtgtatttctcatggaagccttctgtgatatctaaccccactgctatcggcaaaatagtgtctccccgaaattcatatattaaggtcctaatccccaatatctcagaatgtgactacatttggagttagtctttaatgaggcaagttaaaatggggtcattagcatgggccctaatccaatatgactgttgtccttataagaagagagacaccaggggtgcatgtgcatagaggaaagtccgtaggggacacagcaagaaaacagccatgtgcaagccaaggagagagaccccagaaacaaccaacctgcagacaccttgaccttggactttcagtctccagaactgagagaaagtaattttctctttaagccacacagtctgtgctattttaatggcaggtccagcaagctgatacccctgcctgagactgggttaggatcccctgctctgggcagcccttctgtttctccacatcaagatacttaatttctctgcattataattggctgtatccaactcgaagcttcagagcagaaggaactcacctcttccttcctggaacctggcacagggcctggcatataagaagtgtcttctgtttgtaaaatgaatgaatgaaagaatttgggaataaagtcaggatgctgagggttagcttttgtcaaatattgctgtgcagaaatttcattcatcaagtacttattccatgcatactatataccagacactaacctaggtgctaggaagaatgcagtatacaaaggagatttaaaaaatatccttgtcctcaagagtcttatatcgtgctagacgtagagaaataacaagcaagagaagtaaacatacataatggggccaggtctagggtgatacacatgaggcactgactgggtgcaaaatttaaggcagtgcaaaaaactggagtaattaggataaataatttaatgcaatttacaactttaatgcaatttttaatgcaatttttaaaacacaatgcaaaaatatccacaatggacaaaacatcaaaatcttcagtaaagacaagatggttatacagcctgctatgagaaaaaaaaagaattgggaatgggaacaggaaattttgtggagagaggtgttgaggttgtaggtggagtgaccagagaagtccctaccaagaagatgctacttgggtgaagacttgaaggaagagaggagcaatccatgcaaatatctgggaataactttctctgcagatggaacagcaggtgcaaaggcccctggggttgcaccacacttggagaggaactagtgtgactgaaggctaggagttagcaggggaaggggtacaggagatgaggttagaggggtaataggccaagatgcagagagaatgagctgaactcaatattgccaactcattcaaacttagaggctggaaatcaggattttaaagtggtatctcttaatttttaaaggaagtctactaatatgaaaaaataattaaacactgcataggctaaaatcagtagttcactactgcaggcaattttgcctcccacagaacatctggagatatgtgtggctgtcacaaccgggaagcagatgctactggcacctagtggatagaggccaaggatgctgctgaaatccagccttgcggccgggtgcagtggctcacacctgtaaatcccagcactttgggaggccaaggtgggtggatcacctgaggtcaagagtttgagagcagcccagtcaacatggagaaaccctgtctctactaaaaatacaaaaaaaaaaaaaaaaaaaaaaaaaaaaattagctggccatggtggcaggtgcctgtaactccagctactcgggaggctgaggcaggagaattgcttgaacccgggaggcagagcatgcagtgagccgagatcgcgccactgcactccagcctgggtgacagtgagactccgtctcaaaaaaataaaataaaaaataaaaaaataaaataaatcctgcctcgcacaggatagccccactccccccgccttgcaaagaagcatgatttggctggaaacatcaattgtgccttaggtagaaaactctgcgctaaatagaacatagctgtgaatggaaactgttgatgaggtcagcaattccaggaaaggatcagatgggccagaagctccactacggccctcttccctccacgcctcccaaaatgcccacccatttcctttatgctgcagcagaagtgattttccaccacatgcctaacactcctcctcattaagtaatcactatccacagccactcatttccatgtttgtagccagtccaggtgtaaaagacgcctgccctgttcataggagtcagatggagatcagccaattacagggctattagatgaaaatgcagtgccttccttatcttgcctctgtgggttgagctcttcacgatggtgggtttgcgcctgatcagtactttagtccaatgcccgcccagcctggttctctaattctggccagcagagcacaatttcctattctaaatggaacagctccgctgatatgttctgagcagcagcaatattcacccttttgcatactgtattcatagctgattatgcaaatcacatttcattagtcttttcctcattaaaatgatttgaaagacaaataattttggatagacttttattgttgtgcaagggtatgtctaaagcaactgtttttggtgcaatgagctagaacattagtcataaactaaaaaatccccacaaagccctgggaggtactgggaaaatgtgaaccgggtcatcaaaatagaaggtggtggtaactggggcagactggaggcagctcacctagactagaggagacatctagtcctcaggtccagccaatatggcagaatggcaactgggaccagtagggcaagactttttctttgacattttaataggactagaaatctgagattttttttttttttttttttttttgagatggagtctcgctctgtcgcccaggctggagtgcagtggcatgatgtcggctcactgcaacctccacctgctgggttgaagtgattctcctgcctcagcctcctgagtagctggaattacagccatgtgccaccacgcctgactaatttttgtatttttggtagagatgaggtttcgccatgttagccaggctggtcttgaactcctgacctcaagtgatccacccaccatagcctcccaaactgctgggattataggcgtaagccaccacccctggtcaaactctggatttttaaagaactctatctgctttaatacactgaatgggaattctttgacatttatgtagtgtagatgtagtgtgtgggttatcagatggtgatctctagttaggttctgggaactatctgggttttgcatgtgagagtaactcagtccagaaagttaaaaatggactgggtgaagaaggaagggatggtggattcaaggtctgcccaactcaggaatagtggttttcctgcccctaaaccaaagcctcgtcatcctcatcagtatcataatggccatttgtgtgcacagcatcgtaagggaagggccttatcgttaactcatgcgtttcttaaaacaccctgtgacccattttgcagatgagagagctgactcttcataatcacatgacaaatgagtgcatacccagaatttgagcctgtgactctacattctgagctttgatctattactatttgatctattactgctgactatagatataggttggaatgaatgtagtaaagttttaggatacaaaaatcagtagcaattctacgcaccaacaaccgttgagctaagaaccaaatcaagaagacaatccccattacaatagctataaaaacatataaaatacctagcactatatttaaccaaggaggtgaaagatctctgcaagaaaaactctaaaagaccgatgaaagaaatcctaggtgacacaaacaaatggaagaacattccatactcatggatcagaagaattaataccattaaatgaccatagtgcccaaagcaatctctagattgatgtaatccctatcaaaataccagtgtcatttttcagataaaacaaacttaaaatatgtttaggctgggcgtagcagctcatggctgtaatcccagcagtttgggaggctgaggtgggtggatcacttgaggtcacaagtttgagaccagcctaaccaacatggtgaaaccctatctctactaaaaatacaaaactcagccaggagtagtggtgcatgcctgtaatcccagctactcaggaggctgaggcaaaagaattgtttgaacctgggaggtggaggctgtagtgagccgcgatcatgccactgcactccagcctgggcgatggaatgagactccatctcaaaaaaaaaaaaaaaaaaaaaaagtttttaaaaaaaggcccggaaattgtggctcatgcctgtaatcccagtgctttgggaggctcagatgggaggattccttgaagccaggggtttgagaccagcctgggcaacaaaatgaggccccatctttagatagagtttttaaaaagacagatatagtttggcagattattttcttaacaatgtaaagactctagagaaagctgaggttgagtgtttctgaacttgagaaaagtgttttgtagtttttggccatatccctatatgtggagtgggacaaagtcaattagccatccgagagttctctagactcatgaaaggcaagaagacagcaaagacaaagttggccgtcctcaatggctcttaacctatgacctatgggagttggtgtatcaatacccagctccctcactgcccttaagtgcctgttctataccattcaccagagctttgcagccctcgttgcccacaggagtagcttgattgataacactgtacattgacttctttcccttttttatctcactactttcacctctcacatcaactacaaatgcttgtcttagggtcttctcctgagagaacccaaactaagacacaaggaaacctcaaattctttgttttttgtttaacttgcattgtgtttgcatctttttgaactaggctagtcatgtcatcaagtttatccatctgcattcaattaaatttttagacagaggtcccttgctgttgcccagactggatagcagtggtatgatccaatcacagctcactgcaacctcaaacgcctgggcttgagtcagccttctgcctcagcctcccaagtagctggaactacaggtgcatgccagcacaaccaactagttcaaattttttttgtagagatagggtctcactctgttgcccagtctggcctcaaactcccagccttaagtgatccccctgccttggcatctgaaagtgctcagattacaggcatgaaccatgcccaatcccatctgcatttattatgcaatgtctagggtaatattgggcagattacaacagaatttagaactagttttaacttaagcttactagtagaagaattctaaaataaaaggggaggcaagatataaatcaaaaggatttggtcaaagagaagatacttgtattgctgtagttcctgccacgtttccattggttgaaatacagttgattgtctacagtgcagccttaccagtgataaggggctgtcttctttaatcttcctttttaatttgcttcctaattactttaaaggaagaactctttggcactgaaaattactctagattgtaaccaaaaaaagatccagaacctttttttttttttttctatttcttttaatcttcattcaggggcatagtataattgaattaagacgctaccagtgggtgaattacaggataataattcagacctttctgtttaataggggctggcctgtggccttgagtccactagatctgaagggtgaattactgctccataactcactagctcccatttaaagagaccctggttaaagagaattaacatcaacaaccaagtcaggaaaaggcaacccaagacctaagagtaagagatgaggataacacagaaatgaatttggaaagttctggcttctcacttcaaagaaggcaggcttcagagaataaaaaaccttccataaaaaaccaaaggcctctctgctcagcagagctctgggtgttttttcaccaaagccctggcaaacatacccagatgtctcaagcatgcatcctttcagatctaataaaatgactaactgggctttaaacctagcctggatatgggcgaggtgtccggcagttacctgcaccttgaacagagtggacaataacacccaaagtccttctttctgtcttccctaaagtgtatgtatgttatttatttattgtttatttatttagtctcactctgtcatccaggctggagtgcagtggtgtgatctcggctcactgcagcctctgcctcctgggttcaagtgatttttctgcctcagcctcccaagtagctgagattatacacatgtgtcaccatgcctggctaatatttgtgtttttagtaaaaatggggtttcaccatgttgtccaggctggtctcaaactcctggcctcaagtgatttgcccacctcagcctcgcaaagtgctgagattacaggtgtgagccaccatgcccggcccctgatgtgatgtttttctagctgatgcctgaaatgtcaccattagcaatttttttttttaaagtaaaagctgacatccttctgtttcctcttttccaaaaaagagttgacagtggacataagttaaatattatagcacttaagtcatagatatgaattcagatctaaacttcattgactgtgaaatcaaagggaaattgcctaccctctctggtttcaagtttctcatctataaagcagggattgtaatagtcccaacttcttagggctgtcataaaagttagataaaagaatggatatgaaacatagaaaaatggctgacgtggagtaagacttcaataaagaataagcattattccactgcactccagcctgggcgacagagtgagactccatctcaaaaagaaaataagcattattatcgaaaaatatcctttagagactgaaggatgtgaagaattgcattgctgattttagtttctagaataagaatgtcatccagtgtaagagaaaaagggtgatcaattcaatgtggttcatagatatcattctctaagatggcatgaattgatagttcaccgtctttggggtaaacccaacttttgtgaatttctaaaatccaagagacaaccacctcagctgcaaaggatctcatccagcttaggaggtcagtagcagctgataggacaggttccattttcacttcctcttagacatcttgcctgtctctgccaaccttctgctatctgtcccagacttttacttaaagataaaaagagaatgcttataattcattacagttcattaaaatgaaaataaaatttattttgcatcaaaatgaaaaaaagactcatttattattagcatataaatggcatttttaaatgtcactctgcctcaaaatcacttacattttcagtgatcatagcacacaaaattaatttttgatagccttttgtgatttggctggaaattcttatttctttttgtgctttaaacagcaaactgtatccactgctattcatagcaaattttagataatgaagcaattaaaaatacatggatttaagatcttatctcatttttcctttggcctatttctgcttcattattcatgaagggatatgtttaattcagagttagtaattgcagatatatctagtataaattgtgcctcatattctttacccatttcaatttattttagcaaatagatctctgtttgaaaaaaaagtcattgagagagggtgagtatgacaaaaatgcagaaatctgcgtgtatgtgtatattgattgacatatccaaaccagatctcaaaaatgttaataaccacatttcctgaggttttaccaagagccaggcactgtgctgaacaattttacacagcatttcactcaatcctaagagtaactttaggagggctgtatagttagtgctcccattttttagatacggagactgaggctcaggtcaaaaaagtggcctgaagtcacatcattagaaatgacaaagaaccagaattggaacttggcttgtctgtctccacagcctctgtattagaccattcatctcctgtgttctagaacaaagtgtattaaagcctcaaagagatttgtcaaaggctgctaaaatcgtcctgcagttccacctaacagcatccaaagttcataaagttgctggtctgaggagctgtgacttatttggtttccatgagctctaaatatattttaggaatttatcctagagaaataacaggtacacatggtttctttttttttctttcttttttttaagttctagggtacacgtgcacaacatgcaagtttgtttcataggtatacatgtgccatgttggtttggggcaaccatcacctcgtcatttacattaggtatttctcctaatgctatccctcccccagttccccacaccccaataggccccagtgtgtgatgttcccctcactgtgtccatgtgttctcattgttcaactcccacttatgagtgagaacatgtggtgtttggttttctgtccttgtgatattttgctgagaatgatggtttccagcttcatccatgtccctactaaggacatgaactcatccttttttatggctgcatggtatttcatggtgtatatgtgccacattttctttttttattttttttttattattttgttttattattatacttcaagttttagggtacatgtgcacaacgtgcaggtttgttacatatgtatacatgtgccatgttggtgtgctgcacccattaacgcgtcattagcattaggtatatctcctaatgctatccctcccccctcccccaccccacaacagtccccagtgtgtgatgttccccttcctgtgtccatgcgttctcattgttcaattcccacttaggagtgagaacatgcaatgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcattgatagatgtttgggttggttccaagtctttgctattgtgaacagtgccacaataaacatatgtgtgcatgtgtctttatagtagaatgatttataatcctttgggtatatacccagtaatgggattgctgggtcaaatggttatttctagttttagatcattgaggcatcaccacactgtcttccacaatggttgaactaatttacactcccaccaacagtgtaaaagcgttcctatttctccacatcctctccagaatctgttgtttcctgactttttaatgatcaccattctaaatggcatgagatgctatctcattgtggttttgatttgcatttctctgatgaccagtgatgatgagaattttttcatatgtctgttggctgcataaatgtcatcttttgagaagggcctgttcatatcctttgcccattttttgatggggttgtttttttcttgtaaatttgtttaaattcttcgtagattctggatattagccctttgtcagatggatagattgcaaaaattgtctcccattctgtaggttgcctgttcactctgatgatagtgtcttttgctgtgcagaagctctttagttaaattagatcccatttgtctattttggcttttgttgccattgcttttggtgttttagtcatgaagtctttgcccatgcctatgtcctggatggtatcgcctaggttttcttctaggatttttatggttttcggtcttccatttaagtctttaatccatcttgaattaatttttgcgtaaggtataaggaagggatccagtttcagctttctacatacggctaaccagttttcccagcaccatttattaaataggtaatcctttccccatttcttgtttttgtcagatttgtcaaagatcagatggttgtaggtgtgtggtgttatttgaggcctctgttctattccatatgtctatatatctgttttggtaccagtaccatgctgttttgtttactgtagccttgtagtatagtttgaagtcaggtagcatgatgcctccagctttgttctttttgcttaggattgtcttggctatgtgggctcttttttggttccatatgaaatttaaagcagtttttttccaattctgtgaagaaagtcagtggtagcttgaggggaatagcattgaatctataaattaccttaggcagtatggccattttcatgatattggttctacctatccatgagcatggaatgttttccatttgtttgtgtcctctcttatttccttgagcagtggtttgtagttcttcttgaagaggtccttcacatcccttgtaagttggattcctaggtattttattctctttatagcaattgtgaatggcagttcactcatgatttggctctctgtctgttattggtgtataggaatgcttgtgatttttgcacattgattttgtatcttgagactttgctgaagtcgcttatcagcttaaggagattttgggctgagacaatgggttttctaagtatataatcatgtcatctgcaaacagagacaatttgacttcctcttttcctaactgaatatcctttatttctttctcttgcctgattgccctggccagaacttccaatgctatgttgaataggagtgtcaagagagggcatccttgtcttgtgccagttttcaaagggaatgcttccagttttttcccattcattatgatactggctgtgggtttgtcataaatagttcttattattttgagatacattccatcaatacctagtttattgagagtttttagcatgaaaggctgttgaattttgttgaaggccttttctgctctattgagataatcatgtggcttttgtctttcattctgtttatgtgatggattacgtttatcgatttgtgtatattgaacaagccttgcatcccagggatgaagctgagttgatcatggtggataagctttttgatgtgctgctggattcagtttgccagtattttattgaggattttcgcatcgatattcatcagggatattggcctaaaatcctctttttttgttttgtctctgccaggctttggtatcacgatgatgctggcctcataaaatgagttagggaggattccctctttttccattgattggaatagtttcagacagaatgataccagctcttctttgtacctctggtagaatttggctgtgaatccatctggtcctggactttttttgggtggtaggctattaattattgcctccatttcagaacctgttattggtctattcagagatacaacttcttcctggtttagtcttgggagggtgtgtgtgtccaggaatttatccatttcctctagattttctagtttaataacatagaggtgtttatagaattctctgatggtagtttgtatttctgtgggatcggtggtgatacctcatttatcattttttattgcatctatttgattcttctctcttttcttctttattagtcttgctagtggtctgttttgttgaacttttcaaaaaaccatctcctggattcattgatttttttgaagagttttttatgtttctgtctccttcagttctgctctcatcttagttatttcttgtcttctgctagcttttgaatttgtttggtcttgcttctctagttcttttaattgtgatgttagcatgtcaattttagatctttcctgctttcttttatgggcatttagtgctatgaatgtccctctacacactgctttaaatgtgtcccagaggttctggtagtttgtgtctttgttctcattggtttcaaagaacatctttatttctgccttcattttgttatatacccagtagtcattaaggatcaggttgttcagtttccatgtagttgtgcagttttgagtgaatttcttaatcctgagttctaatgtgattgcactgtggtctgagagacagtttgttgtgatttttagtgttttacatttgctgaggagtgttttaattccaattatgtggtcaattttagaataagtgtgttgtggtgctgagaagaatgtatattctattgatttggggtggagagttctgtggatgtctattatgtccacttggtctggagctgaattcaagtcctggatatccttgttaattttctgtcttgttgatctgtctaatattgacagtggggtgtttaagtctcctgttattagtgtgtgggagtctaagtctctttgtaggtctctaagaacttactttatgaatctgggtgttcctgtattgagtgcgtatatatttaggatagttagctcttcttgctgaattgatccctttaccattatgtaatggccttctttatctcttttgatctttgttggtttaaagtctgttttatcagagaccaggattgcaacccctgcttctttttttgctttccatttgcttggtagatcttcctccatccctttattttgagcctaggtttgtcttttcacgtgaaatggatctcctgaatacagcacactgataggtcttgactctttatccaatttgccagtctgtgttttttcattggggtatttagctcgtttacatataaggttaatattgttatgtatgaatttgatcctgtcattatgatgctagctggttattttgcccgttaatttatgcagattcttcatagtgtcaattgtctttacaatttggcatgttttcacagtggctcatactggttgttcttttccatatttagtccttccctcaggagctcttgtgagtcaggcctgctggtgacaaaatctctcagcatttgcttgtctgtacaggattttatttctcctccacttataaagcttagtttggctggatatgaaattctgggttgaaaattctttaagaatgttgaatattggcccccactctcttctggcttgtagggtttctgcagagagatctgctgttagtctgatgggcttccctttgcgggtaacccaacctttctctctggctgaacttaacactttttccttcttttcaaccttggcgaatctgacaattatgtgtcttggggttgctcttcttgaggagtattttgtggtgttctttgtatttcctgaatttcattgttggcctgccttgctaggttggggaagttctcctggataatatcctaaagaatgttttccaacttgattccattctccctgtcactttcaggtacgccagtcaaacgtagatttggtcttttcacatagccccgtatttcttagaggctttgttcatttcttttcattcttttttctctaatcttgtcttcttactttatttcattaatttgatcttcaatcacttgtatcctgtcttctacttgatggaatcagctactgaagctcgtgtatgctccccgaagttctcgtgctgtggttttcagctccatcaggtcatttaagctcttctctatactggttattctagttagccatacgtctaaccttttttcaaggtttttagcttccttgcgatgggttagaacatgctcctttatctcggagaagtttgttattattgaccttctgaagcctacttctgtcaactcgtcaaactcattctccatccagttttgatcccttgctggcaagaagtagtgttctttggaggagaagaggtgttctggcttttggaattttcagcctttctgctctggtttctccccatctttgtggttttatctacctttggtttttgatgttggtgacctatggatggggttttggtgtggatgtccttttgttgatgttgatgctattcctttctgtttgttagttttccttctaacagtcaggcccctcagctacaggtctgttggagtttgcttgaggtccactccagaccgtgtttgcctaggtatcaccagcggaggctgcagaacagcaaatctttttgcctgatccttcctctggaagcttcatcccagaggggcacctgcctgtatgaggtgtctgtcagcccctactgggaggtgtctcccagacaggctacacgggggtcagggacccacttgaggaggcaatctgtccgttattggagcttgaacaccatgctgtgagaaccactgctctcttcagaactgtcaagcagggactttttccatgtggtatcttttaatacaagttgtcacagggttttatacaccagtaaaaaagcaggaaagaggaaagaaaaaaggaaatggctcaacaatgttcaattatatgttaaataaatcctgatgcatttatttagtattatactgtaacaccatcaaaaatgagttgtgaggccaaggcaggtggatagcttgagtccaggagttcaagaccagcctgggaaacatagtgagaccccatctctacaagaataaacaaaactagctggacattgttgcacgtgcctgtagtgccagctacttgggaggctgaggagggaggattatttgagcctgggaggtcgaggctgcaatgagctaggatggcaccactgcactccagcctcggcgatagagtgagatccagtctcaaaaagagaatcttagtttactgacatgtaaaaaatgtgtctgcaggttataaaagtggcaggtccataaaacaatatatgtaatgtatcccttttctaaaaaaaaaaaactacatatgtgtatatatatgtgtaaatgaggaaagagagaagccaggacatctcagcttttctgagattttgcacaacaaaaacataacacaagccacatatgtaatttaaaattttcttttttatttattattattatttcttttttattttattattttttctcccccacttgtaaatagcattattgctttactgatgatcagctttgttttataaaaaactcagaaaattcagtaaagtatgcacaagaaaggaaaaatgtcataactacaccagccaaagatcagtcccctgtatctaacagtgtgtgtgaatcttgctagacctgccctgtgctatttggtggtcatgagccacgtgactcctgagcactggaagtgtggctggtccaaactgagacgtgctgtaagtgtcaaagacatgctggattccagagatttagaaccaaagaagatagtacaatatctcattaataatttttctattggttacaggttgaaatgctaatatttgaagtatttaaaaataaaatatgctactaaaattaattttacctgttttttcactttttattatagctattagaaaattttaaatttctcatgcctgtaatcccagcacttggggaggccgaggcaggcagatcacctgaggtcaggagtttgagaccagcctgatgaacatggggaaacgccacctctaataaaaatacaaaaattaaccgggcatggtggtgcgtgcctgtaatcccagctactcaggaggctgaggaagcattgtttgaacccaggaggcagaggttgcaatgagccaagattgcgccactgcactgcaccctgggcgaaagagtgaaactccgtctcaaaaaaaattaatattttgatacagccatgcaatgtgaaataatcaaatcatggagaatggagtatccatcccctgaagcatttgtcctttgtgttagaaacaatccaattaagctcctttagttatttaaaaatgtacaattaagttattgactatagtcaccctgtgtggtatcaaatagtaggtcttatttattcttttttttttttggagacagtctcgctctgtcacccaggctggggtgtagtggcatgatctgggctcactgtagcctctgcctcctgagttcaagcgattcttgtgcttcagcctcccaagtagctgggatttcaggcatgcaccaccacgtttggctaattttttatatttttagtagagatggggtttcgccatgttgtccaggctggtctcaaactcctgagctcaggcaatctgcccgccgtggcctcctgaaatgctaggattataggcacgaaccaccatgcctggccttatttatttctaggtatttctttgttctcattaacattctccctgtcaccccactattctttccagcctctgttaaccatccttctactctctatctccataagttcattgtttttatttttagatcccacaaataaatgagaacatgcagtttgtctttctgtgcctggcttatttcacttaacataatgacctccagttccatctatgttgttgcaaatgacaggacctcattctttttcatggctgaatagtactccaaatggaaagtctctttagtgatcttctgactcagtcaataaaatgcatcaatattccactgggtatgcatgcctctattctagattctggaggtactggagaaaacaaaacaggcaaaactgccaccctcatggagcatgagttctggtaggagagacagaaaaaaaatgcaagaaaatacgcaatatttcacgtgttgatgagagctatggagacaaaggagaagggagaagaccaaggtgttctaatgaaggatgatcaggaaggctcgtgttataaggtgacattgtgcagagacgtgggggaaatgagtgaatgtgtcttgaggctgagagacagccgtctggcaagtccacaggcccctaagcagaaacaagcttggcgtgatggaggaatcacaaggggctgtaatggctggagcagagcttatcctcccagttgaggaggtaggaagtagaggttgagattttggagtcgagcagacctgagatatctaatatacaattttaaggcactggtgttgctgtgatagaacctttctgggtcaccccaaagtactgacaatgacaaatatattgggcaggcggtgtggggaatgtcagagaaagaggctgagtttttctctgggtccatgcagtgcagagagaagagaataaatgtgagacagagagaaacgggagcaggaacttggaggtagaaataatcaaaagaaacaggaaccctgaggaatctgcaaaagtcttggcaagatgttcaactcataggatgtgggatataagctcaggccaaatttatttaaaatgcaaaggaagaggtgaccacagcttacctctgggccaagcttatttagtataccaaatatttgaagaatcatttcttcttaatttggtttgttcttagtagatgctcccactggtttaaacctgaatttcaagctgttgtgttttttttaaacctacactaaataatacacgggtgggtgaaaagcagaaggaggctttgtgaatgagcttttttaaatagtgagattccttggcatgcataaaatgttatttgggatagaagaaagcttgatttatgaaaatcttccctaggccacgtagtgcagaatcaggggactctggcatcgccgcccggcatgcaaataaacgtttccagcagttctttagagtatgcatttcttgtttttttggctgcagaaagtatggtgtccaaaaattaggtagggtttgctttgcattccagttgtccgtgttgccagaaaacaatgccatctggatgtcattccttcacctagagtaaggcgctgtcaccatgcgtaagcattataacataatctctgggttacagtcctggctggtcactgactagcttggaaagtttaccacaaatcctctgagtctcacttctccctactgtaaaggcaggataattattaatttgagaacacgtttggttgtactgaggatccaataagagaatatttggcagaaaaatctggccaatggtaaatggtattcagtaaataaacacattttggtcgtcagcagagagctacctggattttattttatttccttccttttttttttatcgtagagaaaaatgacagggattcactttctaagaaattacactatgttcaatgacttcccatcaagagtaggcaatgttccgtatcctgccattggtaagtatcaaatgggcccgtgtcagacaagtcatggcttttaatctccctttattggccacgtcacctgtcagtgaccttgactgttgccggctgcctcatgttctgcagtttcctgataagtgtgtttccggcttttgaagttatgtctgccgaaaaccacatctggttcaccgccgcctcaacagacacacaatgaaatacaaaaggctaattctgctgtgtacgcaatccatgtttctttccccagaggattccagatggagtgaactcagtagaggcggtgcttcgacggctgatgatcttgcggagaggagagaggagcattagttacggttttaagtcccggctgaactggcaggggttacatgacctcagactcaggggtaagtgcgcaagctctcgcccctggaagggctgtgatgcctttcaacagccacacctctccgttgaacccatcaacaccctttgtgcagaggtgggttgagatttctcagatgaagtaacatttcctactctagtagtctcaattggtaaatataattgtttttttttttttttttttgagacggagtcttgctctgtcgcccaggctggagtgcagtggcgcgatctcggctcactgcaagctccgcctcccgggttcacgccattctcctgcctcagcctcccgagtagctgggactacaggcgcccgcaaccacgccaggctaatttttttggtattttttagtagagacggggtttcaccgtgttagccaggatggtctcaatctcctgacctcgtgatccgcccgcctcggcctcccaaagtgctgggattacaggcgtgagccaccgcgtccggccggtaaatataactttaatgtggacatcagaaggaattctggtattacgagtggtgggagaagcattttatactttattagggtatgaataacaacatctttatttacttttaacttttattttaggtttaggggtacatgtgcaggtttgttataaaggttaaattgcatgtcattggggtttggtgtccagattatttcatcactcttgtaatgagcacagtacccaataagtagttttttgatgctcaccctcctccttccctccctgctcaagtaggccctggtgcctgctgttcccttctttgtgtccatatatactcaatgtttagctcccacttataagtgagaacatgcgacattagattttctgttcctgagttagttcacttaggataatagcctccggcttcctccatgttgctgcaaaggacataatctaattcttttttatggctgtgtagtattccaggctgtataattaccacattttctttatccagtctaccgttgatgggcatttaggtggattccatgtctttgctattgtgaatagtgccgtgatggacatacatgtgcatgtgtctttatggcagaacaatgtatattcctttgggtatatgcccagtaatgtgatcgacaacatatttatttaaaaattgagcacttatttaaaaaatcttaagtgctttcttcattggctgtgaaagctctgagttttctgtgaatgtcattaggtccattgtacacatgtgaaaagtaaagcaacacacccaaagatggtcagtcctttgaacttgggttgtttgatgtttgtgactattacatagatgccatttatattgagtatatgtctagcagctttattgctgggtcacaggctggacgtatgtttagttgctggagattgccaactcattttccaaagctgttatacccatttgtatcaattttttccaagcagcacagccaaatttgaagctggatctggctgattccagctctaacttttttttttttttttttttttttggagagagggtctcactctgccacccaggtgggagtacagtggcacaatcacaactcactgcagctttgatctccctgggctcaagtgatcctcctaccccagcctcccaagaagctggtactgtaggcatactccaccatgcccagctaatacttgtattttttatagagaagggatttcatcatgctgcacaggctggtctcgaactcctaggctcaagcaacatgccgaagtgctgggactacaggtgtgagccaccacgcctggcccctaatatatatgtgtgtgtattttatatacgtatatataatgtattacacatatttttacattatatatattttacatatatattttatgtattatatattttacatatatattagaaacatttacacatatatatttacatgtatattttacatgtatatgtttatatattttttatgtatttattttacatatattttaagatatataaaattcatagcaggcaaaaacagcttctaatattttgaaccattgtactatatcctacgaaagtactaagtataaataagagagacttcccggagaaccattgctcctggccagtagagggtttggtttttggaggtggttttgttttgtaaacgtctttgttaatatggaacattcagacaagtgcataaatcttaagtgagcagctcagtgaatttttgcaaagtgattattaccatgcagctaccacctgaccaggatataaagcatttctagcaccactgacagccttcctccaactttgttcttattccaaattatctttactctagtgacccttcacaattccacatgccatttagcatgatgcggtcattttccacaacaaaaaaatcctgctgggattttgattgagattgcattgaattgattgattaatctgaagattttgttagattggttctttcttccctaagtattcaaaataattcactggtaaaaacacgtaggcctggggtggttgtgtgtgtgtgtgtggtgtggagggactgagagaagggatgaattataattacagatttaatttctttttttaatttgtaatttttgtgggtcaatagtatgcatatgtattttggggtatacgagatattttgatacaggcatatgatgtgtgataatcatgtcagggtaaagggagtgtccatcacctcaagtatttatcctgtctttgtgttacaaacaatccagttatactcttttagttattttaaaatgtacaatgaattattgactgtagtcatcccgatgtgctatcaaatacagatcttattctgttgaactctgtacccattaactatccccccagccactagcctctgataaccacggtccaactctctatctccacaagttcaattgtttttctttttagctcccacaaatgagtgagaacatgggaagcttgtctttctgtgcctggcttatttcaatgaacagaatgacctccagtttcatccgtgttgttgcaaatgacaggatctcattctcttttatggaggaatagtactccattgtgtatgtgtaccaaattttctttatccattcctctgttggcgggcacttagattcttctagatcgtggctactgtgacaagtgctgcagtaaacacgggagtgcaggtatttctttgatacactgatttcctttctcttgggtatatatctaacagtgagattcctagatcatagggtagttcaatttttagtttttttgaggaacaccctagatttaatttattagctattggagtattcggattttctgtttcttatgtcagttttgctaggtcatttttagggaaaaacttccattttatctaaatcttccaatctattgacttaaagctgttctacaacgcatcaaggaattattttatgtgatagatacgttctatgtgttgattgtggtcatatttacatgggggtatacatttgtcaagtcttattcaactgtgcacttaaaatgggtacattatatgtatttacattatatgtaaattatagctcagtgtggttcaataaaaatttacaattgataccattttatttttacctgtacttatgaaaaaagttaaaaagtttaatcatatcaagtgttggcagtaagataggctacactgcaagagagggtatacattgccacaaccacctggaagaacaatttggaaatactatttatttatagattgattgatggagtctcactctgtcacccaggctggagtgtagtggtgcagtctaggctcactgcaacctctgcctcctttgttcaagtgattctcctgcttcagtctcccaagtagctggaattacaggcatgctccaccatacccagctaatttttctatctttagtagagatggggtttcaccatgttggccagaatggtctcgaactcctgacctcaagtgatccaccccccactggcctcccaaagtgttgggattacaggcgtgagccaccacacccagcctggaaattcttttaaaatgggaaatgattatatgctatcacctacagggacacattttagggagatcctcacacatgtgctcaaagagatgatgcaacatttattgcagttctgtttgtaagagaaaaaaaaattaaaaatgtaaccatcactcagaggtgaatggtggtaaacatacatggtaaaatagctcttaaatatagcaaattaaaattacatgtttgcaacttggacaaatccctcaaaggagtgagaaaaaaattacaaaggaactacagttgatgccatttatatataaatttttaaaagcactattcttcccccggtgtcataaaaattttagctgagtatgtggaaatccagaataaagatttccttgcagctaggtgtgcccatgtttaagctatgttcaacaggatgtgaggtgtgttcagcaattctggaaaccttccctaagtgacagctgaggaaaaccttttaactctgtcacttccttctcctacctgtctttcccccttttttctttctgtgtttgtttcccagggctactgtaagcagacaggaggagtctccagggattgtaggaatttaatccatttgagcaatcaggctgttttacagcttcctgccctgcagcctgttcttccccagccctgggtagaaagaggtcatcttgtcagtttaaaccagctcctgacaagtgatgaacccaagtgaacgttccttattaccatgctcaagtctctaccctgggaaaagctatagcttccttaccataacatgcaaactatgtgctggcatgatgacttactgtgtctgtacatctacgtgggatgacgtgtaccctctctcctctctatcaccccataaaaccctcgtcactttccctctgagagacactgctttggagaatcctcccagtgtcgtccttacttgagccaagtaataaaactcccattgatcaaaacctgcttccttgtggagagtcatttgttacttgtcaggggaatgaaccccggtgtttttcgggtaacgctactgtagcaaagagctgtaaactaggtggctttaaacaacagaaatttattctctgacagctctggaggctttagaagtctgaagtcagtgctctctgggggctctagagaagaatggattatgtgccttgctcccacctccttgtgttgctggtgatctttggccctccctggctacagatacatccactatctgcccctgtcttcagattgcatcctctcacatgtgtccgattctgggtctctcctcttcttataaggacacccgtcacactggatcaggacccaccctaaaccagtatcttaacttgatcacacctgcaaagaccttattttcaagtaaggccacatttgaaaatcagggggggtggggttaggactttaacatattttttgtgggaacacagttcaacccacaccatcttcctatcctcctcctatttctttaatccttctaaacctttctgtgggttgggatgtgaatgtgatagcaggagctataacagctgtattggaccatgaggtaaattcagaaatagactccaggaatggaggacctaaaaaatcaaagacagttgggttcctaacataataatgaggccacatcaggtatagactacctatgaagactctcatatgcaaaataaataaatatttatcttttaaacctctcttctctttgtgttggggttttttcacttgcagtcaaatctaatcttaatacacacacacacatgcacacacacacacacacacatttgctcatatgatttgttggactctaagtgtgaacatactaaacttatgaagcgtggctatctctgaggaagagagagtagaatgagaaatgatggtcagagggaacttcaacttcctctgacaccttttatttctttaagtaaaagaagacaaatatactaaaagtttagtattaatagctttgaattatagatggtggaaatctttgataacattaatatttgaattttgaattttaaaaatttgtccttccagaatctcctcaaatattaagaggactctatttgcaccttttactccaagtcgcatgaatcagtgtgaaattcctggaatgtactggctattttttttcttttttttgagagagtctcactctgtcacccagggtggagtgcagtggcgtgatctcagttcactgcaacctccacctcctgcctcaagtggttctcctgcctcagcctcctgaataactgcaattacaggtgtgcaccaccatgtccacctaatttttatatttttagtagagatggggtttcactatgttggccaggctggtcttgaatttctgacctcaggtgatctgcctacttcagcctcccaaagtgctgggattacaggcatgagccaccatgcttggcccctgcactggctatttttgaccctctctggacatactacctgccccagttggactgtcctccttttcctcacctgggcatctcctaagcatcctccagtctcagctccaagttaatgacaggtgatgagacatctaagtaaacatttggaaaatcagcgaaaattaatttccatcagattccataataaaagcccaatagatggttctttttcataattgcctaaattacaaaagtaacacttgctcaccataagaaatgcaaagaccaggataataaaacttgataagagcaaaaattgaaatctgccttttatcatctccattgtatcccaggcacaactaatctgtataaaggtttaaatatcttaaaactaaactgtagagcactaggataaaattggggactattttaaaaatccaatggtaggaatgaatatttcttacatggaactgaaggtggaaactttaaccagattcttctgtaattaaaacagttttaaaaatcttacataaatgaaaaactaggaaaatatctgcaacatatacaatggaccagaattacaatatccttaatatgtaaagggatatttcaaattcatacagaaagaaaaaacaggtattttattttattttattttattttatttgcgactgagtcgtgctctgttgtccaggctggagtgcagtggcgtgatctccactcactgcaacctctgcctcctgggttcaagcaattctcgtgcctcagtctcccaagtagctgggattataggcacctgccagcacgccaggttaatttttgtattttttctagaaacaggtttcaccatgttgaccaggctggtctcaaactcctgacctcaagtgatctacccaccttggcctcccaaagtgctgggattacaggtgtgagccactgtgcccagccacaacaggcaattttggagagcaaaaactaagtgtaactggtacataaaaataaataatatctgttgatggggagaatgtaggggaatttgcacattcatataattctggtggaattgaaaaatcaacaaaactttctaggagaaaatgtggccctatgtatcaaaagcctttaaaaagatacagtatccccctttattaatggtttggatgtctggggtttaagttacatatagacagtccaataaaatattttgagagagagagagagatcacattcacataacttttattgctgtatattgtcataatgttttattttttgctaatcttttattgtgcctaatttataaaataaattttatcataggtgtgtatagataggaaaaaaacatagtatgtatagggcttggtaccatccttacttccagccatcccatgggggtattggaaagtatacactccaccaccgccctgtggaaaagggagtctactatgcatgattttgactcagtgatttcactaggaatcccttaagagaaaataaagaggactatgggtgagctaccaatctattcgtctcaatggtgcatatagtagcaaagaaaattgtaaacaacctgtttataatcttcattaaacaaatgatggcatatttgttcaatagaatagtatgaaggttattaaagtgacttaatttcttcagaagatgtttgcaatgtattaagtgaaaaattaaaaattatataaatccatctttttaaaaaggtgtccgtacatgtatatcatacagaacactggaagaattatatatcaatgtgtgcaaggggggatgtttcagaggggtgggactatgggtaattttcatttcctttttgtttgttttgttttgttttgttttttgaggcagagtttcgctcttgttgcccagcgccatggcacgatggctcactgcaacttccgtctcccgagttcaagcgattctcctgcctcagcctcccaagtagctgggattacaggcatgtaccaccacacctggctaatttttgtatttctagtagagacggggttttaccatgttggccaggctggtctcgaactcctgacctcaagtaatccatctgtctttgccttccaaagtgctgggattacaggcatgagccactgtacccagcctcatgttctttttatttatcaatatgtttacaatgaggaaaatgtttaaaaaggtcccagttgaagcatctcatcctttgggaagccttcctgccctccagtccttataaatacccttcctgtgtgtgttcactgtgtgtatctcacaagactagcaagctgacctcttcagtgttaatttccttgttctgttcattgttcatcactagagtataacttccttgaggaaaagagacatgtcttgccttgtcactgcattctcaatttgtagtttgaagaatgtttgttgaatgatgaattgaaaatgtccttttatttggtcttttaagtaactatctgctagcatcccactgtttaataatttataaaattggaaatcacaaatttctaatgggagtgagtaattgcttcaaactctggttttgccaatggagaaacagaggctggggagaaacgaagtgacaaccggtgttgtgtggtgggctaggggcaggctaggaccacacctgctctcacggtttttctcctgaggctttcacagaccagactgcttagcaggcctcctgatttgcttttgttatatggggaaatctgacacacagagaatcgtgagggggatgaatgtttctagttagggcaggagggggcagtgagaaagggagaaatctggctgcccatgagaaacaaggtttaaaactagattttatgatattccacctgtctccatgctctgaaattgtgtgcgtgtgtgcgcgcgcacatgtttacttcatggggaagaaagtgcaagaaaactttatctcgggcagcctggcaaattcaacctctaagacagccaccctcagaaatctgctcaagctgttcctttctttcctcaaatgtcccctgatggtctccccacctctcaaatttgctgggtcattgcatctgtttctacctggctgcatctgagtagtcgcagtgtcagtaagtgaatttgggcttccagctgcgggcctcagcaagtttatctctgaaaatggacctgtcttcacacttaatcgtgtctctgtgtcccccatctctgagcaaacagctggaaagtgagttgagtcaaccagtagttggtctgcatggggctttctggatgacacatattttgatatttaatcctcaaaacgttttgatatttaatcctcaaaaccattctgtgaggaagagctgtcatccccattttgtagatgagaatactgagtcccagggagagaaggttaccttccctgggttatacagccgcaagtgggtgaggctggctgagaaagctgagggtttgggtatgaggaagttaaatttgctttcccccttctggcaggtagcatttgcaagggccgtgtgtttaaaaacaaaaaatgactttagtattcataatacttaggaacacgtaataaacactgaacctggttctctaccttagacttcataatttgaggagaagaaattcaatgtagtcatttttaagagatccttgtcccttcttgaggttatacaagtatcttaggacttgtgagtttttgggaaaaataaagcccagatgggtcctgtgttttctgtgggtgttgttattatttatttttatttattttattatactttaagttctagggtacatgtgcacaacgtgcaggtttgttacatatgtatacatgtgccgtgttggtttgctgcacccattaactcgtcatttacattaggtatttctcctaatgctatccctcccccatgcccccaccccacgacaggcccctattattattatttttgagatggggtctcgctcttgtcagccaggctggagtgcagaggcgcattcttggctcactgcaacctctgtcccctgagctcaagagatcctccctcctcagcatcctaagtagctgagaccccagatgtgtgccaccacgccttgctacgttattttatttatttatttttgttagagacagggttttaccatgttgcccaggctgatcacgaactcctgagctcaagcaatctgtctgcctctgcctcccaaagtgaggggattacaggtgttagccaccgtgcccggccctgtgggtatcattattgaaggtgcttttgttttctgttctggatggctcagaggtgtctcttgaagtgtcatctccgtggaccacagattcagccataggtatccacaccgatgctctagtatcatacacacactgcacaggcctgcagcagtcattgttgccattgacaaatatttgttaccaaggtttccaccccttgcagaatacccacgctagtcttgcggatgtatcatcctaggagtgggtcagttctgtattcagactccagagccgagccccctgtggcagagtaggagtgcccaaacctgcaagatcctacagccgtgcttgccatcttgagatgtagataacatttttatcattctctttaaactatttttcttattttgttgaggtatagcttatatacactaaaatgcacaaatcctaagtatacggatcaatggatttgtatacaggtatatgccttaggtaaccaccatccagatctagtcacagaacattttcattaccttagaaaaatccctcatgacctattaaagttaccccactgttggatgtaaccactgtctgatctcaatcactgtagcttagctttcctgtttttgccattcatataaatggcatgatccagaaggtactcttttgtttctagcttcttttgcccaaaatatttttgaaaatcatccatgttatttggttttaccacatttcattctatttgtattaatgtttcgtattacattgtatttgcatacagcaattatctcttttcctttttatagacctttgcattgtttccagtttgggactagtaagaataaagtttctatgagcattcttgtacaaatgtttttgtgggcatccatgagatggtttggctgtgtccccactcaaatttcatctcaaattgtaatccgcatatttcaggggagggacttagtgggagggaggtgattggatcacaggggtggtttcccccatgctgttctagtgatagtgagttctcgcaagatctgatggtgatgtaagtgacgatttcccctgctctctctctcctgcagccttgttaaggatgtgcatgcttctcctttgccttccaccgtgattgtaagtttcctgaggccttcccagcaatgcagaaccgtaagtcaattaaacctctttcctttatacgttatccagtctctgggaagttctttatggcaatgtgaaaaatggcctaatataatacatacttgtttctcttgggtataactctaagattgaaactggggtcttatttaattttattgggaactggcaaattgtgttccagagtaattgagttactctgtattttatattcccattagcattgtgtgggagttccagtcactctacatccttgccaatacgtctattattcttttttattccatcccagtctacaggaaaactggatgcttattttctccatcagagttttccgccatgttgtactttctgccatattgtatatatgttgctgttcctactggggacatatacaccaaagtttaagatcatggtttttcattttcaccctggatttctccgaactgccatccagctttccttctcccctaccttaaatcttacttactttaattctgtttggaaaagtggaaagtaatatagatcaagtagctatctcctattatattcaaagtaaaatgtatattagagaagtaggtataagaaaatcttcatttagggccaggcacagtggctcatgcctgtaatcccagcactttgggaggcagaggtgggtggatcacctgaggtcaggagttccagactggtctggccagcatggtgaaaccccgcctccactaaaaacacaaaaattatctgggtgtgatggtgcacgcccataatcccaggtacttgggaggctgatgcaggagaattgcttgaacccaggaggcagaggttgcagtgagcagagatcactccactgcactccagcttgggtgacaaagtgagactccatctcaaaaaaaaaaaaaaaaaaaagtcttcatctgggggcagtctagtgtaatggaaaattctagaattctggactcagatggccctgtcccttactgactgtgactttagacacatgatttaatagcatggaatttcagattcattgactataaaatacagagagtaaaaattcaatgacataaaggaggtaaaacagtatgctacagactaggtaattcttctcaagtacatttcaattttagtttgtatcagacaggatgtgctgtggttaccacacgcagcccccaaatctcagtggtttagcatgatggaaatttgttttttactcacattctatttctaaccctggttgttggagctctctcatcagtcacttaggaacctagtctaaaggagatgtcactttggctccaggttgcatgaataatagcattgagtgctagtgggggaagggggtatggtggtaaattcgggtgtccagtcagcaaatatgtgctgaggaacctattctgtgataaacattggaaagacagaaacaaacaaaaaatactgtacctgcttccaggagctcacagcataataacagcaataacaaggacaacagcaactgtagctgcagcagcgaaaagttactgatcacttatgaagcccagcactgtatcaagaacttattttatgatgcagatgttttcccaatcagaaaactcagataagggaaaacagaattttatttttctgtaactgaatttcattttactcttaagcacccacttccactgcaaaattgaattagagaaaatgtaatcacttctggtttaaaactcagtctcttgtggatactgctcagttgacccaactttctaccctttgcatttctctctgtctttcccactgtgtttaaagttcctggtgtgaggtgcaggctttagtattaaggcatgccagactttgggaagtatcatctgttgttacctgtccccacctagtgtagttatgtgtccctttgtttctaccactgctgattgatcgtggttctgtatctgttttggggtcaatacatccacatccctaatccccaaatgtgagaatgttttggtcctctggttctcacggccacttctgtgcccttcgtggaaacttaggtgcttccggctgctctctccacaccacactggcatgaggatctgcaaggctgccctcagtcttccccacccagaaaatccccatggccatttctactctgtggcttgggtaccatgtaggtcaaagaacttctctataaatcgtacagactcctgggaactgtagcagtggctcccctgctctgggatttccctaaacttatttatggcttctttcatcatccttaccctagaccatagttattctgtttatccaggatcaacgtatacaagtgtaatggttttaagtgaccttaaataaatgcccctgaaaagataggccaatcagtgttccagctgcagatggaaactaatcactactattttgtaatagggataataatggtgtaagttcaggactgaaatacaagcaaaggcctgaagccagaatcagtatgaattaggattctgtgtccattcatcatgaaggctgatcagttgttggctttgaacagaaggctcatgccttgattagagctgtcagtggtagggagtaaattaaaatgtgtttgtgctccactagtgtgtttgaattttaaatcactggaaatccctgtgtggcctaaactagaagttttctcatatgcaaagggatggagttggaacagatagttgatccctaagtacccttccagctatgaggtattctgtttcataataggatggtaaacaatcttaactcattcctttgtaacttaatttttctgcatcagggaagaatagcagccagtgcttggtatttaagcaaaacatacatttataattcatttatatgcagtcatatatattataaatgggaatccaaaggataccacccttaataagcaagtgagaatttatgaactcctttgcttccaacccactactattatttatcttatattaatggcctctctacccagtagactgctctaagtctattaactttcttttttaaaatggcatctttcagatttggtgcaagccattgggctgtaggctcatttgcaatttctccattttttatgaatacagtgatttatgtcacggggatgtaatggctcattttgggtctaattttgactcccacttggattcaaggcatctgagcatgtcttatgggctcaacaagcatctagttgaatgagttgattttcatgatgatgatagttgtaaggggcaattgagaaggtggtttataaatgaggccttggggagaatgacatagttataatgactgctggctttggggacagacattcttagtcccactttctatctctgtaatattgagggaggttaactagatttgaggggccttgtttatgtatctacaaaatgagcacaattataaccaagctcctatggtggtaattaagagttcaacatggtaatgtatgtaaagggacttagcaacttgccttgcacagagtaagtgttcaataaagcttagctgctattgtaatgtctaccccacacctggtcccatgaacttatttctgaacttttcatcacggaggactgtagggagaagccaacagagctgttttcacaagggaccatgtgaaatgttaaggtgggtccagaggtcctggaatttacatttaaagccaggagctaaaaaaatgagaattattactgttcctgacctcatttgtccctcgggctggtgaggcttagggtacatttatatttgctttcttatatctatacctttcttttagtcttggtgtttttcacattgacagagccacaaactaactagaaggctacatactcctcagtaagaatagctaacatttgcagcatgtactatatgtcaggcacaatcccatgtggttttacaggaatatctaatagaaccctcacaataatcttttgagggagatcattattgtataattgaaaaagcagaggcttagtgagatgaaacaatttttggtttgtatcagtcagtatgagctgtgttgtgctgtggtaacaagcagctcccaaatctcagtggtttggcataatggaaattcatttcttactcttactgtatttctaacactgactatttggagttttctcatcagtcactttggaacctaggctaaaggagacttcactttgataccacattgcacaaatgatagcactgagtgctaactggagtaaattcgggttttgagccatttattcaacaaatgtcatcaataaaagaaggagctggcattcaagtcttgcctgtctagaacactcaatcttaagcaacccattgtgaacataatcccatagccctcaaaggcctcaccttttcaccaactagttctgttccttttgtgattgatgatgcaatttcagtgttttaaatgttgtatttacattgattggggctgctgagatcattcacacaaatatgtctagccataaattccagagaaactgtgccatgcagttccaaattccttcacttctcccaccagtacaagggcttcataggagcaaagatttgcaaatgatgttcccatccaacacttaacacttcttatttttaatcgagacatcttctgctcaccacttttggcactctgcttgtgcagccttctctagtctccagacaacagctattttctctgttagccaattaccctccactgaaggttccagtatcctcatacctgcagaaaaaaattacctggaaagaatgcacttttctcagggcccagacggtgatggattgtaccatgatggtttttgttcacctacaccggtggattttcctttcctgctggaggaaaagatctcattctgcaaatgcactaatgatgtgtaattatcatcgctgcaagccttctacgcatctgggctaatggttccagcttccatgatgattctcatatgttacccaattccatatttgagtggttctgtcctgcccctggtaacagtaacagttggcttctagacaaacttaaatatcctggctttatatacctggctcatagcatgtgatgataatagcaatcaccacataagtttcaatcatatctttactcacagaagggagatactcttggttgaatatttaattcagttttgttaaaacttgaagtcttcttgaaacagcgctgcctgacagaaatatttaacgtcaggaattcatgagcaatgggaccccaaggtcaaaaaaggggaatgagtagtcaaatccagccttgcttgtcacagcagactggagcttcaggaattattaagcaggcagtgggaagaacaaaggggataatgttctttccattgaagtaatttttctcaatgcaaaatgctttttcggagtccatgtgggttaatttccacccattttgcatgtaggagacatgcatccaagtcctcagtctcagagttggaagaaatattttttctttattttccttatttctagtaaacttcaccccaaaccctcaaacagttaggttgcttaaaataaaaacaattttggtcaatactgaggcttccctacccctagagtttgtttattacagtagttattgaattgaatccttgagataggactttctgttgatgtgcatactacctgaaaccatgtgaccctcttcttctattttaacattggagcccaagacccttttgtggggttgctgtccccttaccctggggtcctgctttcagaggggtacttgatagcttctcctttgatatctaaatttcttgggtgctgctccttcataaaggccaaagttcccactgtttgcaagacactcacttcccaactgcaaccccctttccatttctaggggtggaaatcctgcctcttcctgctagttttcccttccttggtctgataaatccagttcatgtctttatcttgtgaatcctctgcaaattgctatggcaaaaatccctaagatctcttttgagatggaagaccaaacatacagcaaagaaaacacagattaataattcaaaaacatatctgccactggtaaaaaaaaaaaaaaaaaaaaaaattagaatcaaaccattaatttctccttacactttctcctgcagcagtgaatatactacaaagcttggtttctgtgataataggaataaggcttactgagctatattgcatttcctaattggatcattcttcaaccattttatctcatgggtatctaccctgccttttatggttggggtggttttcttttcctccccctcttagatcttaattttgcaaacaaggactgagaagtggcattaagatcagcctcattatcacattgcagtttggcaccttattcctctctccatctttattagcagagtctctgatttttttaagcttatttgcataatttctaacatcccgggtttattcagaaggccttttgatgaaggaatggagaaggtcttctctactccaaaggcctcttcattaggacacagtggaacacagcacctaagaacacagactccgcaggcaactgaaaagcctagatttgagttctacttagccgcttctgggctgcgtgacccttgggaagttgttcaacgtctttgaacctcagtttctccatgtgtagcaatagcagctacatctcatgaccaatctgaatcactccatggaaaatacaacagtgtcctgttcatgctattgggcgttgttatcattatccttttctctttattaatgtaaacattttactgaagaatgacgtacatacagaaaagtgcctgtgtcataagtataaagctcaaggggttttcagaaattgacacatctgagtcaccagcatccagatcaacaaacaaagcattggcaaaactcctaagagcactttcacagctctttcctgccactaaatccttccccgcaaggggtaaccactctcctgacttgtaacaattgcaggttagttttacctatttttgaactttatataaatggagtcaaacacgatgcactatttttgtctgatttccttttcctgatatttttcatgagattcattctctgttgtagtcagcagatataattcatttttaattgctgtatagtgttctattttgggaatatgtcacaatttttatccattctacttttggtggacatgtatgttgtttctgattttgggctatgaaatatagcaatgctatagtatatctaatgcatatattttggagaatttgtatatgtatacatttttataggcatatatttaagcatgaaattactgagtcacaagttatggatctgtttaactttagtagacactgtcagtgttcccaagtggttgtaaaatttacactccctccaacaatgaaaaataattccagttgatctacattctcaccaatgtttggtatcattgattttgttcattttaaacaacatggtgggtgtgtagtcatattgtgggttatccatcagatagctgatattttattttttcaacttttcatttggaaataatttcaaacttacaggcaagttgcgagattagtacaaaattgtatgctcttcacccatatacatcaactgttcatcattttccacatttgctttattttctctctgtaggcgtgcacatactgctttttaaaaatatgaggtaagtttcagatatcatgcctcatttaccactaaatgtttcagagtgtgtgtaccaagaactatctcttaaataaacacagtatagtaatcaaaatcagaaaaactcaccactcatacgatataattatgtaacctgtagatcttattaaaatttttccaaatattcctgtaatgtttttgtagcatttttttcatgctctggatttaatccaggatcatgcattacatttagttttcatgcctctgtagtcttctttaatatggaatgtttcctgtctcttgtcgtctttcaggatattcacatgttatgaagagcataagaattactgtaattttggcttattggatgtttcctgatgagattcaggttatacatttttggtgaattattatataagtgatagtgtgttcttctcagtacatgacgttggtttgttctgtcactattgttgttgactttaatcactttgtcaaagtaatatatgctaaacttcttcactataaaattactttcatccccttgtaattaataaataactttaggggatatactctgaggctgtgtaagtatactgtacttcatcaaactttcatgcacttatctcagcatctattgatgatacttgcctgaatcaattattactatgatggttgcaaataactttctaattccattgctcctccattaattagtttgcattctacagtaaggaagtgctttcccttccctccattaattaattaatcactcatcacaatagagaaataaagacattagactaagaagagcaacacagtgatatatgctagaatagtgggcatgacaaacgaaacagcacttgagatctgaaagacagctaaaaattaggctatcaaagaggaccagaaaaaagtgaggcaataggaaaagcacaagcaaaggctgtgagttcaaagacagcctgagaaaaattcaccatggttggggtgtagcaagtaaagggagacaagtgaaggttgaaagcctggaaggaaagcctgaggcaatcattaagattaactcctcattcatgacagtgggtttctctatttggaaagattttttttcactgtgtctgcctgcgtcaggcccacccatactcaaattcttatctatttcttttaactattgcttttaaacagaaaatccccaagtttagtggcttaaaacaatgatttattatgtcttgagcttttgtgggtcagcagtgggggcagggttcagcagggtggttcttccactccatgtgacattggctgaagtctcttacttggctgccttcttgattgcctggactgggtttggaagtccaagaaacttctctcacatttctggggacttggtgcctcttcacatgacctccctctttccatgtgatagttcatatgttagtagtcaagcccatgcatctttacagcatggtgggtcctcctaagagcaacagtgggagctgccaggactcataaaggttattactgacacaagtcacttgcattgcattctattgacaagttactgggccagcccagatttcactgggagaaaaaaatggatttcatcctttggcaaggagggaaggaatcttcagagacaatctatcatgccacctctttcaggaagtcttccctgacttctccaatctcattttctaccaatctatcaatcacagttattgttctgagcctttgttaggctcattttatatagtgctttgtggtatttccaaaatttttcaagtgtcaatattttagctttactgattcctgaagtagaacctcatttacttaagtgcagtaattaataaatttggataataataggctgtcatttatggaatgataaccatgcatctggcctatgcaagatactttaccttaattatctaattatatccgcttaagaagataaaactgtctttattttttaacagaaagaaaaccaagtcccagaaggaaaacaaattgcttaaggttgtctgacaaattaggggtagagtcaacattgaaaccgaggtctgtgcaattctaaaattgtgttgcaatcttcctacatataatcatttattgagcacaaactatgtgttagtctccttgcttagcactagggattcagaaatgtgtaaatgcccttagtctaacagagaaggaagatgtgtaaacaaacactgactactcagtgtttaaaggcacagcatgttaaatgctagagtggagttctgagactccagaccagggttcatcaaccctgccaggaaaggttggggaaggcttgaccatggcagggacatttgaattgcagcttgaaggataaataggaattcactaaggagaggaggaggggaggggaggggagattgatgggagatgaagttggagaattaggttccaattgtaaagaaagggaaggaaaggaaatcattgccattgagcatcccttgtaagcttgtcccattgaatcctaaaacctgctctgaaagtgctattctcatattcccgttctcatagataggaaagcgaagctaagagagatcaaatcatataccaaaggccgcattacatagtttggactttatcttataggtatcaggaagcgaacacactttcaaaaccagcgcatgacctgacctgacagagaaatgaacattgttgtcatatagagatgggaaagagtgggtagagggtagtagtgtacagaccagatttagggggttgttcctactaccagccatgaattgatgaggaccttgatgaattcaatggtaacaggatggagaggaggggctgaacagaacttagggtagtgtttatgaggtataaataatgagactgacgcactggtaggatacaaaaatgaagggagaagagtcaagaattcaaagcttctaggtttggttgatattttcatcaaaggggttatgggagtcacagagctcaactgatatcccttagttgcttcacaaattactctctctctgaatctcacttgtccatacctgaaaatgcagataagataatagtgttacctacctcattagctgacttaaatggagctaacacatgaatggtgctgagcacaaagctcggctcatggcaatgaatatcaactctcattcattcaatgaatatctattggataccttccacaggccaggaactctcttaggtcctaggaagacagactataaataagattctcaaagttcctatgcttacggaggttacattcgtattacgtcttgttcttatacaacacataataatacaaaagttaattgcagagaatagtaaatatacaaaggaagcacataggctaagagataaagggaagctgtcaagggcgctttagatggggaatgggttcttaactgtaagtgacctgccccaccgtcacccggcggacatttggcaatgtcaagagacatttttgatggtcacagcttggaggcaagtgctactggcatctagtaggtagaagccagggatgttgctaaacaccctacagtgcacagaacagccccccagtgcaaagaatgatctggtctcaaatgtcaatactgctgagattgagaaaccctgagacagggttatgaaagagtcttttcagtgagggcatatttgggctgaaagctcagggaagacaaggaacaggtggtgagaagagctgaccagagagcatttcagaaagaggaaagagtaactgcaaagtccagaggagggaaagaacttcttgtattcagggatcagaaaagagactaagtggctcgaacgctgtaaggatgggagttggcacgtgcagagattagagaagttagcagctggatcatgcaagatctcagaagccacataaagagtttgtcttttgttctaagaatactaggaagcctttcgagcacgttgaaataagacacaccccctgttcagttttacatttcacattttaaaaaactcatgctggctgcattgtggattaaagagagtcaaaaaaaatcagaaggctgttgcagtcactcatgcaagagatggtgacgatgaagctagcgttttatcagtggaggtggagagaaacggacaggttagaaatatgttttgaaggtagagcagacagcacttaaagacatcagatcccaggggtgaggggaatgagaaatcaaggatgactcctaggattttagcttgaggcactgagtaggtggtggtggtattcattgcgttggaaagatgtcagaaggaacaggtttgggaggttgttttggacttacaggtttgagatgctaatttttaatcccagtgaagacgcaagtatgcagacagctggatatacagagctgaagctaccaggggaggtcagggctgtaattatacattacgacatattttataatataattccttcttgccgaagtctccctgcatatcatcctgcatgcagatgtctgaagtctcaaggaggcattttctcagaatcattgccaagcccaacactgtgatatttttaaagtgtcacatcctccatgcccctctttgaattgagtcacatgtttaattaagtttccacttacaacccaagtaaaggggaaaaataaccctaaagaattgatccgtgcctgcagagctttggaattttgggtggctaccctctctgcttctctcttccttttttctttctttcttctttttttccccacttatttgctagggacattttcattctcaagttgcgattagttttggaaatgggggtcttgcagtagagagtattgaggaagccctgtccttaagaagtcgtcttcacagatgatgacaccgaatggctgaaatgcagcagaaggatctctgggttaagattcagaagacctgagccctcagcttggtctgaccacatgctgaccatgtcaactcagggcatggtctcagcttcccgttcttttgtaaaaatgggagagaatccccaacagatgtgagtctttgtgaaaatcatatgagatcatatgtctaaggtctggaaagcatgcacattttacaaaagccatcacttcccaccccctccgtcaacaccaccctagtccaagcctccgtcatatgttcccctcattactacaatagtctcctgactgctctccatggtactgcttctgcccactccccctgccagtctgttcttaacagccagaatgatgccatgaaaatatgtcacatcatgtcacttccctgctcaaaaccctcccactcatatcccactcacctcccactcacggtgacatttggagtccccatgcaacgctactcaccattcaacagctctcactcatatccactgctgggtccacatcagccacacggccttcctgatattcctggaacacattaggtggaatcccaccctgaggcctttgtacttgctgtttcctctgtctagaaagtctttttctcagatagccacatgcttccaatgccttcttcccagggaggcttttcctaatcactttaacacagattgccgtctctccctcctgccccacatgcactacattctccttctatactttaattcacagccttttacttccaaacatttcattttccttttcttccttttttttttttttttttttttttttttgagagaaggtcttactctgttacccaggctggagtgctgatcatagctcactgtagcctcacattcctgggctcatgtgatcctcatgcctcagcctcctgagtagctgggactatagactcaagctaccatgtcaggataatttttaaatttttctgtgaagacggggactagcaatgtttcccatgctggtctcaaactcctggcctcaagcaatcctcctacctcagcctcccaaagcactgggattacaggtatgagccaccacgcccactagcccattttctttatatcttctgtgtttcatccgtcttcatctgatgaaaagtaagctcagtgaaggacgggatttttctccgcattttgttcaagactgtattctgtagcacctacaacagtgcctggcacagagaggtgctcagtaaatatgaagaatggacagatgagaaaatggaaacacaaagaattaaaataacttgcccaaagttacagatgggaaaagggtgtgttcacattcagacacctccacttcctcaatggacagttgaaggtgatcatatctttcccggtttcctcaccggtcattgctagaagccaaaggaatgcgtgcctcgtcccctcagagagcgcacactaccatacagagtacgtggaattcagtgaggccatgagagggtgccattaatagacttgtgtgtgtgtgcctggagtacatccctttggctcatctaatttcagaagtggacaacttcaagcatgctccaggtgtctcacctctgagctatatacaggtatatacacctctgatacatatacctgtgtatatcccagcttttctatccctgggctttcttggagcaaggaagtttagtccatgtgcagaacagcctggctgtgagcaggagaggatgttcccggggcacctgtccctcaaccagtgggtgtgggtggataaatgtcccaaggtcctaccccttgctggggtgaatctgcagcacatgctatgtggcatgtacctgcattacagaggatctttgcaggattgcacccctctgtttttcactcctggctcttaaaaagtcgcctccaaaacattacctgtctccacacccatgttgcagactttgctttcaaggaaacccaaactaagagagtgcctgcaaaggggagctcgggatttgggttcaaagtttcaaatcccagtttggctatttgcccttgtgaccctgagcatgttccttaatttcctcaaagttccccagcaagtggagacactaatatgaagcttgcctgcttggaggaagaaggaatataggcagtgacctgtcccgatgcctgagatataatatgctattaaaaaatggatgctgatattattataattacacaattgtaattattgatatcaatagttattataaatatgtatttttgtatgtgttcatgatgtgatcggtcatgttcatgtgtatgcatgtgactcaacattcttattattcatctttgtcattcaagttaagaaagaggacatgggaaggcaaaaaaggaggtatatcctaagggaggagattaaaggacccctagactccacaaattcctaagctgtcatggtagagagcagtctactgctttttgaagctcttgtcaacccctcagcatctatacttctgacatattccatcaacctgtgtattaatatggctcatatttctaacaagtgctcacatggtgctttcattctggcagaaactgttaaaacttctctacacagaaagttctttatccctatgtcacagatgaggaatgtgaagcccagagacgttggccaaccttcccaaggtcacacagctaggaaagggcaaagctggatttggacctaggtggtctggcttcagagtccatgctggtaacccctctgctgtattgcctctttgcacaagatcagcagaacctagggagcaatttcgctgccatcccagcagcctaggggaaaggagacatcatagtttccttatttgataacttcataaacgatagcatttagtgcaaagcagcgaggtactccagaagaagcccaatctactcatctctgcaaattccatagatggccttgtcatgatgtctgggttgctgtgatctccacttctgccttcagtttgttcccatggccagatgaaaccccttggaaagaacaaaactattatattgctggggtagagaagagtgtagttttacagaagctgaatggcgtggaaccatgcagcttaaattatcaggctgtgatggctcctatcacctagcaggtggagagagaacagcagatagaaaagactgacttctagcagctactgaggtctcttctccttgtcaacagagacttagatggtagatttgaagtggaaaatgggaatttgaaaattagagacaaagaatggcaattagtttagctaaggcaaaaagatgggatttttaaaaagcaacgttttgctaagtcagtgctggggaacaattttatcaggaagtaaaaataaactctggtttatatgtattatggaatgtgttatgtctcttctactgcatgttgatggctacgtgagggcgagagctatgctggggaccaactggaggtgctatgtggagaatagggatgcaggatgtggaatcaaatggtctggattcaaatcctggctcttagcagctgtgcaggctcaagcagattttgaatgctctctaaacctcagtttccatgtctgttaagtggataatttgccttttctgtagggttatactgaggattaaatgacataatccacatatatttagcacagtatcgggcacatggcaagctctcagtatttgataactgttatgacgacaaagttataaaatgggtgaagtcctgtgtcttgtttcaaagatggatacacactgaaaggatgaacaacaacaatggtatataacagcatcaaaaagaagtctaggccaggcgtgatggctcatgcctgtaatcacagcactttcggaggctgaggcaggtggatcacctaacgtcgggagttcgagaccagcctggccaatatggcaaaaccctgtctctactaaaaatacaaaaattagctgggcatggtggtacacgcctgtaatcccagctatttgggaggctgaggcaggaaaattgtttgaacctgggaggcagaggttgcagtgagccgagatggtgccattgcactccagcctggttgacagagcgagactccacctcaaaaaaaaaaaaaaaaaaaaaaaaagatttacacaggagaccatgaaacttactaattgtttttcctactgaagatttttattcattatgtatagcataattgttaagaatattgatcttgacatcagacaaacaaggctttaaattttcattctatttactcaccgtgagcagtcagttgatctctctgaaccttagttttcttaaccataaaatggggatgatagtaccaaacccctggggttgtatgaggattaactgagaaagcagataaaaagcattttgcatgtgaattgatattattgataatattataaacatgaatatgtgaatgtgttcatgacttttttccaggtttatttaaatataactaaaaaatattgtatacattatggttcacaatgtgatattttaatagatgtacacattgtgaaatgattaccacaatcaagctaattaatatatctgtctcctcaaagacctaaaaatggaaataccatttgacccagcaatcccattactgggtatatagccaaaggaatagaaatcgttctgtcataaagacacatgcacatatatgtgcgttgcagcactatttacaatagcaaagacacggaatcaacctaaatgcccatcaatatagactggataaagaaaacgtggtacatatacaccatggaatattatgtagccgtaaaaagaatgagatcatgtccactgcaggaacatggatagagctggaggcaattatccttagcaaactaatgcaggaacagagaaccatataccacatgttctcacttataagtgggagcttaatggtgagaatacatggacacgtataggggaacaacacacagtggggcctgtcagagggtggagggtgggaggaggaagaggatcaggaaaaacaactaatggatactaggcttaatacctgggtgatgaaatgatctgtacaacaaacccccatgacacatatttacctatgtaacaaaactgcacatttgccccaaacttaaaagttaaactatatatatatgtgtgtatatatatacatatatacacacatatacacgtatatatacacaatatgtatatatgcacatatacatgtatatatagtgtatatatagtatatatacactatatagtatatacttatatataatatatgtatacatatactatatatacaagtatatgtagtatatactacatatacttgtatatgtagtatatactacatatacttgtatatgtagtatatactatatatacaagtatgtatagtatataggtatatatagtatatacatacttgtatatatagtatatatgtgtatatgtgtgtgtatatatacttatatatacatatatacgcatgtatatacacatatatacatgtgtatatatatatttacattgtgtgtgtgtgtgtagtttgctaaggataattgcctctagctccatccatgttcctgcaatggacatggtctcattctttttacagctacatagtattccatggtgtatatgtaccacgttttctttatccagtctatattgatgggtattaggttgattctgtgtctttgctattgtactatatatgtagatatatacacacacatagtatatatttatgtttactatataaatatatatagtatttatatatactatatatatttatatatagtgtatatacactatatatttatatatagtgtatatacactatatataaatatatagtgtatatatactatgtatttatatatagtgtatatatactatatactatgtatttatatatagtgtatatactatatattaaaaatataccataaataaaaaatatatataatatacatatacactatatatagtatatatacacactatatatttatatatacactatatatactatatattatataaaaatatatactatatattatatataatatacatatacattatatacagtgtatatatacactatgtatttatatatactatatattatatacactatatatttatatatactatagtagtgtatatgtatactatatatagtgtatatatactagtatactatagtagtgtatatatagtgtatatatactagtatatatactagtgtatatatactagtatatatactagtgtatatacactagtatatatactagtgtatatacactactatatatactagtgtatatacactactatatatactagtatatatacactactatatatactagtatatatacactactatatatactagtatatatacactatatatatactatagtagtgtatatatagtgtatatatactctatatatatactatagtagtgtatatatagtgtatatatactagtatatatacactatatatatttatatatatataaaatcacctcacatacttaatattttggtggtgagaacatttaagatttattcttttagaactttcaagtatacaatacatcattaactatagttgccatgctctacattaggtctccagaatatattcattctgtttaactgaaattttgtatcctttgaccaacatttccctattctcccacctccaccccaccccaagcccctggcaaccaccattgctttccttctactctttgcttctgagtttgacatttttagattccacatgtgagtgagacaatgcagtgtctgtctttctgtgcctgacttatttcacttattataatatccaggcccatttatgttgttgcaagtgacagaatttctttttttaagtctaaatagtattccattgtttgtgtgtgtgtgtgtgtgtatacacacacgtttatacatgtctatccgtgggtcaatggataaagaaaatatggtattcacccattaatagacacttcagttgattccgtatcttgactattgtgaatattgctgcaatgaacataggaatatagatatctcttcaatttcatttcctttggacatatgctaactagaagactagaagtgggattgcaggatcatatggtagttctatttttaattttttgaggaatctccataatggctgtactaatttacattcccatcaacagtatacaagggttccttttctccacattcttgtcaacacttgatatcttttgtcttgttgataatagccattctaacaaatacggggtaatctatctcattgtggttttgatttacattttcctgatgattggtgatgttgagcattttttcatatacccgtcagccacttatgtgttattttttgagaaacgtcttttcaagtcttttgcccattttaaaattgggttgttgtattgctattgaattgtttgagttccttaaacatcttgcatattatcctctcatcagatgtatggtttgaaaatattttcaccctttatatagattgtgttttcattctgttgattgttttatttgctgtgcataagctttttagtttgatacaatctgatatgcctattgttgctttttgagtcatatccaaaatatcattgcctggaccaatgtcaggaggatcttttcctgtgttttcttcctgtggtttataggttcaggtgttatgtttcaatctttaattaattttagttgatttttgcatgtggtgtgagataagaatccaatttcattcgtctgcatgtggatatctaatttttttcaacactacctattgaagagacagacctttcccttgtatgttcttggcatcttggttgcagacaaattgaccataaacatacgggtttttatgggctctttcttctattccattggtctatatgtctatttttgtgccagtaccatgctgttttgattaagatagctttgcattatggtttgaaatcaggttgtgtgatgctttcagctttgttcttcttgccgaagactgtggtggctgctcaagattgtggtagctatttgcagtctttgatgatttcataccaaattttaggattttttttctatttgtgacaaatgccaatgacattttcataggaatggcatttagtctatggataactttgggtattatgaacattttcacaatattaattcttccaatacataaacacagactatcttttcatttatttgcatctttttcaatttctttcatcacagttctacagtttttagtgtacaaatcttttacctccttggcaaaacttatttctaagtgtttcatttttttgtagcaattgtaagtggacttttaaaaatgtttttggattatttattagtgtataaacacactattgattttgtatattgattttgtatcctgcaacattacttcattaattagttctgacaattttgtgatggagttttaggacttcataagattatgttatctgcaaacaaagataattttatttcttcttttccaacttgggtgccttgtattcctttcttttgcctaattggttgggctaggacttccagtactatattgaacagaagtgtcaagagtggacattcttgcagtgagccgagatcgcaccactgccctccagcctgggcgacagagcaagactctgtcccaaaaaaaaaaaaaaaggacattcttgtcttattccttgtctcagagaaaaagctttcagctgttcaccagttcaccattgagtataatgttatctgtgggacattattatgctgaggtacattctttctatacctaatttgttgagagtttgtagttaggaaattacgttgaattttttcaaatgcctcttctgcatctgtggagatgattatatgatttttatactttattctactaatgcgatgtagaatacttactgatttgcatatgttaaactattcttgcatcctgagataaatcctaattgatgatggtgtataatccttttcatgtgctgttgaattcagttggctagtattttgttgaggattttatctatgttcctaaagcatgttgatctatactcttccattcttgtagtgtacttttctggctatggtatccgggtaatgtcagtcttgtaaaatgagtttggaagtgtttcctgttctttaattaaaaaaaaaaaaaaaagaaaatgtgttgttaattatgctttaaatgtttggtagaattcaccagtgaatgtcttgggtttttctttgttgggaactttttgataattgatttaatctccttactgattgttggtgtgttcatattttctatttcttcataattcagtcttggtgggttgtatgcatctagaaatgcattcatttcttctaggttatccaatcattcatagtatctcttatgatgctttatatttctatatcagctataacatctcttttgtttataactttgagttccttttttcttagtttctcaatttagtttattttttcttaaaaaaaaaaacaactcttagtttcattgatattttctattgttttctaccctctttccactgactttgggcttagtttttcttcttttctagttctttggggtataaaggttggttgtcaggttgtttacttgagatctttttttccttaatgtaggtatttagcactataaacttttagaactgtttttgctgcattccataagttatggtatgttgtacttctgtttcattcgtctcaagttatgttttgatttctcttttgatttcttctttgactcattgattgtttaggagcatgtcatttaatttgtcagtatttgtgaatttccctattttcctcttcttacgggtttctaattttataccactgtaattagaaaagatgcttgatatgatttcagtcttctcaaatttattaagatttgttttgtggcataatcctcccattctggagaatgtttggtgttcacttaagaatatttattctgttgctgtttgatggtaggctcttcttgtctgttaggtccatttggtttatagtgtttgtctgttattttcttattgatttttctgtgtgaataatttattgttgaaagtgaggtattgaagtctcctactacttttgttcatttagtttggtttgttacatagatatagtgcatgatgctgaggtttaggggatagatcctatcacccaggtagctagcatactacacaataggtagtttttctttttttttttttgttattatactttaagttttagggtacatgtgcacagcatgcaggttagttacatatgtatacatgtgccatgttggtgtgctgcacccattaactcgtcatttagcattaggtatatctcctaatgctatccctcccccctcccccaaccccacaataggccccggtgtatgatgttccccttcctgtgtccatgtgttctcattgttcaattcccacctatgagtgagaacgtgcaatgtttggttttttgtccttgtgatagtttgctgagaatgatggtttccagtttcatccatgtccctacaaaggacatgaactcatcattttttatggctgcatagtattccatggtgtatatgtgccacattttcttaatccagtctatcactgttggacatttgggttggttccaagtctttgctattgtgaatagtgccgcaataaacatatgtgtgcatgtgtcttcatagcagcatgatttataatcctttgggtatatacccagtaatgggatggctgggtcaaatggtatttctagttctagatccctgaggaatcaccacactgacttccacagtggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgaggagcattttttcatgtgtctgttggctgcataaatgtcttcttttgagaagtgtctgttcatgtcattcgcccactttttgatggggttgtttgtttttttcttgtaaatttgtttgtgttcattgtagattctggatattagccctttgtcagatgagtagattgcgaaaattttctcccattctgtaggttgcctgttcactctgatggtagtttcttttgctgtgcagaagctccttagtttaattagatcccatttgtcaattttggcttttgttgccattgcttttggtgttttaggcatgaagtacttgcccatgcctatgtcctgaatggtattgcctaggttttcttctagggtttttatggctttaggtctaacatttaagtctttaatccatcttgaattaatttttgtataaggtgtaaggaagggatccagtttcagctttctacatatggctggccagttttcccagcaccatttattaaatagggaatcgtttccccatttctcccatttcttgtttctgtcaggtttgtccaagatcagatggttgtagatatgcggtgttatttctgagggctctgttctgttccattggtctatatctctgttttggtaccagttacatgctgttttggttaccgtagccttgtagtatagtttgaagttaggtagcgtgatgcctccagctttgttcttttggcttaggattgacttggcaatgcgggctctttgttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgtttttggtgtataagaatgtttgtgatttttgcacattgattttgtatcctgagactttgctgaagttgcttatcagcttaaggagattttgggctgagacgatggggttttctagataacaataggtagtttttcaactcacaacccctttcttcctcccaactttagtagtcaacagtgtctattgttctcatctttatgtccatagttacccaatgtttagttcctacagtgtggtatttggttttctgttcccgtgttaattgttaggattatggtctccagaagcctccatgctgctacaaagaacatgatttcatccttgtttgtggctgtgtagtattccatggtgtatgtgtatcacattttttcatccaatacaccattcatgggcatctagatggattccatgccattgctattgtgaatagcactgtgtggaagaaatgagtttatgtgtctttttggtgggaagatttatttttctttgagtatatacccagtaatggcattgttaggtcaagtgatagctctgttttaaattctttgagaaacctccaaactgctttccacagtagctgagctaatttacattctaatcaacagtgtataagcatttctttttctccacagtctcaccagcatgtgttatttgattttttaatagccattctgactcgtgtgagatgttattgatttgcatttctctgatgattagtgatgatgagcattttttcgtgtttattggccacttgtatgtcttctgtcttcttttgacaagtgttcatgtcctttgcctactttttaatgtggttatttggtttttgcttgttgatttgtttaaggtccttttagattctggatgttagacttttgtcagatgcatagtttgctagtattttctccaatgctgtagattgtctatttactttgttgatagtttcttttgctgggcagaaactttttagtttaatcaggccccacttgccaactttgtttgttgttgttgttgttgttgttggaattgctttcagggacttagccaaaaattctttgtcaagactgatattgagaagggtattccctaggttttcttttagaatttttataatttgaggtcttacctttaaatctttaatccatcttgagttaatttttgtatacggtaaaaagtagcgttccagtttcattcatttgcatatggctagccacttatcccagtaccgtttactgaatagtagaaagtccttgccctgttgcttgtttttgttgactttgtcaaagattagatggttgtaggcgtgcggctttatttctgggttctctattctgttccattggtttatgtgcttgtttttttttcaccagtaccatgctgttttggttactgtggccttatggaataattagaagtgtgatacgtctggctttgttctttttgctttggatcgtttgggctattcggtctcttttttggttccatatgaattttggaatactttttttctaattccatgaaaagaacatcggtagtttcatataaatagcattgaatctgtaaactgctttgggcagtgtggccattttaacaatatcgagtcttccaatccataagcacagattggtattccatctctggtttctttcaacagtgtttcgtagttcttgtagagatctttcacccccttggttagctgtattcctaggtatttccattttttgtgtgtggctatcataagtgggattatgtttttcatttgactatcagcttgaacattattggtgggtagatgctactgatttttgtacattgattttgtctctttgtccttcttaatagttgtttgtttaaagtctgttttatctgatgtaagaatagaaacctgctctttttattttcaacttgcatggtagattttttttttttttggtccctttactttaagcctgtttatgtcccttcatgtgagatgggtctcctgaagacaggagagaggtggctcttgtctttgtatgcagcttgccactttatgtcttaagtggggcattaagtacatttacattcagggctattattgatacatgagactttgatcctgtcattgtgttgttagctggttattatgtggacttgtttgtgtagttgctttatagtatctatgggatatgtgcgtaagtgtgtttttgtaggagcaggtgccatttcttggtttccatgtttagcactttttaaaggaactcttgtaatgcttgtctaattgtaaccaattccctcagcatttgcttgtctgagaaggattctatgtctcctttgattatgaaactcagtttggcaggacatgaaatttttggttggaatttctttcctttaaggatgttgaaaataggctcccaatattttctggcttatacgttttctgctgagaggtctgtctattgctagcctgatggggctccctttgtacatgatctgatctttctctagctgcctttaagatttttttttttttttgcatttatcttggtgactctgatgactgtgtgtcatggggaggggcatcttttgtagtatctagccagggttctctgtatttcttgaatttgaacgtcaatctctctagtgagattagagattttttttgtggactatatcttcgaatatatttttcaagttgcctactctctttcttcactcaggaatgccaacgagttataagtttggtctgtttacctaatcccatatttcttggaggttttgtttatttttttaaaattcctttttctttatttttgtctgactgagttaatttgaaaaaccagtgttggagctctgagattctttcctcagcttggtctattctactattaatgccttcaactaaattaagaaattcttgcagtcaacttttcaattccagaagtttagtttggttctttcttaaaatggctcttttatctttcagctcttggattattttactggattctttggattgagtttcaacttgcttctgaatcttgatgaacttccttgccatctatattctgaattatatgtctgtcattcagtcatttaatagtggttaagaagctttgctgaggagctagggggctcatttggaagtaaggggacactgtggctttttgaattggtagagttcttgcactgattcttgcactgatctgggagggctggtgttccttcacctgtggtgtaagttgagtattttcagttgggctcatttctggatgtttttagagggccaagactctgtacaggatctttatttgtgggtgaatgcctgtgcttggtttcacaggggtattagccaaataatttttggcaatgtagtttgagccatgatccagtagatggtgcttaaaagtaatggccagcaggtagggtcttagccacatggctcttttatatttcctcacgtttgcaggcatgctctgccatggcaaagggaggtggggagagatgacctcctcaccagatccactcctaggccttcgaggattcccctcttatcactggctccacacccatatttattttgttaggtgttcagggccgcagggctcccttgggcagaggctgtggcagagagacaggccacattctttctggactggccctatagagggaggtatgcctcactcccttgctggcccatgaacttggacattttaccattctcaatgctctgagtgtgggggctcctctcccactcaagtgctggccacagatctcagctcaacactcataagctgtgtaccatggctgagacatcaggatggcccaactgtggtggtggattcgaagtgctcccaggttgctgggaaagtgttcaggtggagcaaagcactcaggctgggcagtggaggctgtgctatgcagcctgtgctgtgcccgtggtcctgtggggcaggcaggcaggagtcctgggaaaggctagtgggcaggaaggcttatagaacagatgttccccagtcctgtgggaaggctgaccctgctctcttctggcctggtggtcaactggggctagaacctcttggagggagatggggagcactggggtatgcgtgtctgtggctacactctgccagaactacatttctgggttctctggtggctgaagccctgactctgcctattccctgggcagatccccctgctagctcacatgtccatggggaatgtggggccccctgtcctattacttttgtattgctgtctgcttctccctttagttgtgttaatatttgcattatataattaggtgttccattgtttagcacatatatatttaaacttattatatcttcttaagtgaattgactcttttatcattatttaatgaccttttttatctctgtcacagttttggacttaaacatctatttttttttcctgatgtacatatctctgcttttttgattactattatattttatttattacagcttatagaatatctctttacatcccataattttcagcttatatgtgtacttaaagctaaagcaaatctctagtaggcagcatgtagatgggttttggctttttactccattcagtcactctgtcatttgattagagaatttaactcatttacatttaaataataattcataggtaaggacttactacgaccatcttgttaattgttctctattttgtatttcttttgtctcatccttcccctcttgctatctttctttctgttttttgtttttgtttttgtttttttttgtagaggtatgctttgattattttctctttatcttttgtgtataccctacatattttttctttgtggttgttatgaggcttacataaacatcttgtagttataatagtctatttgaagctgataactacttaatttcaactatatacataaatatctacagtttaacttctccttcccccgtatttgtgtcattgatgtcacaatttacatcttttatgtatcatgtatccattaacaaattattgtacctatatttttaatacttttgtcttttaacttatatagcagagtcagaaattatttatggaccaccattacagttttagagtattctaaatttgactatattcttacctttgcagtgaattttatactttcatatattttcatattgttaacatccttttctttcaacttgaagaacttcttttagggtttttttttgtaaagcagatctagtggtgctgagtccccacagcttttgtttgtctgggaaagtctttatcttgccttttgccttcattttggaatgatgactttgctgggtatacattcttggtcgatagttcttttttttttttttttttttcccagcacttggggtaatatcatctcattctctccttgcctgcaaggtttctgctgaggagtatccttaaagttttagggaggtgcccttgtatgtgtgatcagttgcttttctcttgcgactttcaaattgtctctttgacttttgagaattttattataatgtgtctcaatgaacatatctttatagtgaacctacttagagttctttgggcttcatggatctggatgttcatgttcctcttcatccagacataggaagttttctgtcattatttatttaaataagctttttgcccttttttttctttttcttctccttctgaaactctcatcatgcatatattggctcacttaatggtgtccatagtcctgtaggttttcttcctcattttccctcagtttcattctttttgtcaccttaactgggtaattccaaaggacctgtctttgagctaattcttcttctgcttagccaagtggatgttgaagctctctgaaagttttcagctcaatcattgcgttcttactcaaaaatttctgtttggttctattttttttatttttatctatttactgaacttctcactttgttcatgaattattttcctgatttgacatagctgtctatctgtgttcttctgtagctcactgagcttctttaagatgattattttttattgtttgtcaggcaatttggagatcttcatttttttagggttggctactggtcctttattttgtttctctggtgatggtatgtttctccaattacacgtaatcctgtagtcttgcattagtatctgcacatttgaagaggtagataccactttcagtgttttaaggacaggctttggcagagaaagcactttaccagttagcctgtttagagactctggtcaggccatcttgcagggttcatgggttgcctgctgctggaatcctcaggtgggctgggagcactgatgtctactggagtgggtctgaaccttgagtctcttggagcctgggcctctggagacaagcctggagcctgggatgggcctggaggctgagcccacagtagtgggcctgggtcctgggccatcaggagcagtcatagaggttggatttataaggggctagcctagtgctaggtgggccaagagcctaggtctggagtggtcagcctggagcctgggcctgcaggtgctggcctggtgccttgggctgtgggagccaacatagtgctgaggtaggcctggaggctgagtctacgggggcaggcctgagtcctgggtctgtggcagtcatcctagagcttggaactataggggattctctggaactagggcttggtccccaggctggggcaagcctggagcctgagtctgccagggtaggtaggcctagatccatgggattatgagggctgacctggtgctggggtgggcctggaggcttgatctatgggtactggcctggggctcaaggccatggggctgacctggtgccaggtttcactggcacaggcctgatgtttgggtctgtggtgaattcacatgttcacttcactctccttcccccacagggagcacacgtgtctctgcactgtgctggggttgggaagcggtggtgtggataatgtgaaactgtccttattaccttcttcagtgcatttttttttcttatttgtgtgctacacctaggtgctgtaatctctcacttgaatctcttagctcttgtgaaggtatttttatgcatagattgttgtttaaactgatgtttctgtgaggggatgagaaccagaaagttctattctgccatcttgctggcatcgctcccctagggacctgttcatgaattcgtgaattcgtatagcgtgtaaaagtattattttacacccaagataatcaattttactagtttgtgttcgggtctgcatgatggaaatcaatcagccaactctgagtggcagagtctgttacattggtgttaaaaaccagtctatgttatattggtgtttaaaaagattctgaggtcacatttgggattagtaggaaagaatgctttgattgattagtgatgtcttccattggcatggaaatggagagggacacttttttgagacaggctctggctctgttgcccatgctagagtgcagtggcacaatctctgttcactgcaacctctgcctctcgggctcaagtagtcttcctatctcagcctcctgagtagctgggcccacaggtacgcaccaccacgcctggctaattttttcttttttcttttttctctctttttttttttttttgagacggagtctcgctctgtcgcccagcctggagtgcagtggcgcgatctcggctcactgcaagctccgcctcctgggttcacactattctcctgcctcagcctccccagtagctgggactacaggcgcctgccaccatgcccggctaatttctttgtatttttagtacagacggggtttcaccgtgttagccaggacagtctcgatctcgtgacctcgtgatccgcctgtctcggcatcgcaaagtgctgggattacaggcatgagccaccgcacctggccctggctaatttttttctatgtttttgtagagacatggtttcgccatgttgcccaggctggtctcaaattcctgagctcaagcaatccacctgcctcggctatctctcctgttccccatccctcaatctctttctgtctcttgttcttgagtgtgtcttttttagatcttgttctccctttgacagcttcctctttggcttggcattttatcatttttcttagcagctgggattctctggcatttctaagtctattttaaacactttgtaaggtttgatttagaggaaaatctgatttccatagtttgtgcattggtacctcaggggactcttagtttgattatgtcctgaaaaggttgtgataagctcgggctctggcagccctgataggcgtggctcagtggcctttcagctgcttccatctgggttattgaagctttttagcagcccaagagcaccaggctctttacctcattgtagagttccagtctcatttttgttttgccagaacccctggggaactgattaagatgattctgatttagcaggtctggggtgagacgtgagattctgcatttctaacaaacagacgtgagccaggcgcggtggctcacgcctataatcccagcactttgggaggctgaggcgggcggatcacttgagttcaggagttcaagaccagcctgactaacataaagaaaccccgtctctactaaaaatacaaaattagccgggcgtggtggcacacacctgtaatcccagttacttgggaggctgaggcaggagaatcacttgaacctgggaggcagaggttgcagtgagccaagactctgccattgcactgaagcctgggcatcaagggcaaaactttgtctcaaaaaacaaaaaaaaaaaggaaagaatgctccttctgtcttgaaacctaatttcacctggcaaatggagtttctcctcctatgtgctccctttgaacccacatgacattttatagtatttctgatgggcttcttcccaacttggactctaataatctctattcatttctctctccagttagaccgagtgccactccagggcttgctatggaaaaataaaaacgcaaaatagaacattccaggccagtacatgtagtaaagaccgtcatgatgccaaacatgacaactttggccttctccagtgtagtgatgcctgctgctctgaaaagcagcagccttatttacaagagctaaagcttggaagcaacctaagtgtccctggatggatgaacagataaacaaaatgtagtatacacatacaagggaatattagtctgcctttaaaaagaaggaacttctttttctttctttcttattttttgaagacagagtctcactctgtcacctaggctggagcgcagtggtacgatcatagctttctgcagctttcagctcccaaggtcaaccaatcctccctcctcagcctcccaagtagctgtgactatgggtgcatgcctgggtaactttaaaacaaaaagtttgtttgtttgtttgtttgtagagatgaggtgtcactatgttgctcaggctggtcttgaactcctgggttcaagcaatcctcttggctcaacctcccaaagtgctgggattacaggcatgagccaccatgcccagccaggaaggaacttctcacacaacgctgcaacatgaataaaccctgaggacattatgctaagggaaataggccagtcatcagagaacaaatgctgtatgagttcacatacatgaagtacttagaacagttacatgcatacagatagaaagcagaatgatggtttccaggggcttggggaaggggaaatggggagttactttttaacaggtgtagagtttttcttagttttacaagatgaaaagagttagtgagatggatggtatgatggctgcatattattaaattaatgctttctttttttttttttttttttttttaagacagggccttgctctgtctcccaggctggagtgcagtggtacagtctcggctcactgcagcctcaacctctcaggctccagcgatcctcccacctcagcccccccatgtagctgggattacaggcatgcaccaccacgcctggataatttttatatttttagtagtgacggggtttcgccatgttgactaggctggtcttgaattcctgggctcaagccttgacctcccaaagttctgggattacaggcctgagccaccgcggccagcctattaaggtatttaatacttctgaactgtacaatggttaattaaattaaggtatttaatacttcaatggttatgctggtaaactatattttatgtgtttttccctctcccttgtggttttcccctgcggcctcctacagggaaaagaggggaggacctatatccttcttcgatatcatctctatcctacagcttgtaggatatggtacagcttgtaggatatttttaccacaataaaaacttcttataaaaaagcattggccttgcacaaaaaggccagagttctagcctttcctggcaggaatacactgcactgggatcccttgaagccctagactagcccccacatgcaggagatttggaatatcctcactagacatcagatgaacaggggtctgtgtgacttctttaattttccatcacatatcttgtcttgccctaagtttccattcctgctgctgcctgggacagatatacaagagaaactggttttacataattttttccattgtaaatttattcttggcaaagaatcaaacattcaaattctttcacaggattatttcctttctctaggtctctttctcctttgtctcttgaaggtgacatctgagctcgtaaaacagtttgtttctgtccgtgtgctggacatcgtcctttctggcctctgctgcagaattctgagtctcaatttgaccctgagtgccctgcactggtgtccactgcagagaaactgctccttcctgatattttttgagcatgttactgatcgcccctgctgacattatagatctctgccattggctctggtcctaaggttacctcattctgtgatctcctcaccctaagccaggcctcttctgctctatcaattctctcagaaattctgagcccctctaaaaggaaggaggcagggaatcttgttaggtttttctgcaggatggctatgttggggagacaccataacatcctaatgtatgtttggggttggcaaacattggcccaaaggttgcttgtcacatgactttgtaaataaagttttattggaacagaactacacccactcagttacatattgtctatggctgcttttgcagtacagtggcagagttgatcgtggtgacaaaggttatatagcccgcaaggctgaaatatttactgtctggccctttgcagaaaaagtttgctggcctttggtctttgtggtggagtccagggttgtgcaggacatatcctatgtggctgtatgtgacagccctggctttctgtaccaggctgtagcaggtgggactcagtgaggtccctcagccatggctgtctgaccagtgccattccataccagcttggggaatgttgcaaggagtttctttttggattccagctttctgtcataccatttggggtttccaacttcaggttgagggacccagcagtatcttcatctttctttctcaaaatgtctttttttttttaatcggagtcttactctgtcacccaggctggagtgcaatggcgtgatcttggctcaatgcaacctccgcctcctaggttcaagcaattcttgtgtctcagccttccaagtagctgggactacaggcacatgccaccatgcccagctaatttttttgtatttttagtagagatgtggttttgccatgttggctaggctgttcttgaactcctgacctcaggtgatccacccgcctcagcccccaaagtgctgggattacaagtgacagccgctgtgcccagcctcaaaatttctttctcctgtggttttccccctttggactcccaccccttacccagggttggaactacttatcttctttgtaacaggtaggacctattgccttcttctatatcatctctatcctacaccttgtagaaagtctctatgctcagaactctaagggttgctttagaatttagaaatatacctttctctctcaagaaagcctggactattgtctcatgatgacattgacagcctattttggaaatcaaaaagtagacattgctccattctctttgtgtttctgctgcaactatcccaatccttcccaaagcaatagattctctgactggggagtggaggcattcatatattgcaagaacatcatcttctttgagtaattatatctggcactgtgcctggatcagagtagctgataaacaaatatgatcttgtggcagagggctacaggagagcgttagcatctagattccttgatctaatatgaaacccatccaaagagaatgagatattctgaagaatcattctttacagcaggaaacaaattctgccttagagactggaccctacattttgtgaaagggacctacgtccatgacatcatccaggtgtggccaagccgtcatggcattccagggaagctccggttacagcgacacgttctcacttttcctttatttgacattcagccactcatatggggatagctttcttcagtcaccataaccacagccagcttacacatttgtctctttgaaattaatcactctttagactgcttattctaatttctgcttcctgaaggcagagccagcaggcatctccacatggtttctccgttctccagctggaatttctgaaggacactgtgaggccacttccatttccgctgcctcctgaccctcttctacatcccagagtctaccttacatcccatgaatggacaagcagtggcgtatttctgactgcgtgggctccctgctgtcacagggcacttgctgtcaacagaaagcaggtgttctgggaagactggaggagctgtgggtggtgaggcagacactgggcttggctctggaagcccgaactcagaacattaagctgaaccatctgaagctcctccacgaaacaggttgtgcaagtctctcttcccctctctatgggttcatgcatattcataattagaacaactccaggccgaagataatgattcatgcaggaagcgccattctgaacattattatctgggagtgacaaatgaatttctaatttaacatgtgtattgcacaaatagatcacaagaactttaaagtcaaaagcatcctttggagtcatgcaacttctgttgtaatgtagcataaaatgataggggaaggaggggatctcccactggtgggctgtgcatagcggttcccttcaaagcagaggagaaataaaagggggtgagatttcagacactgtttgagtctactatagaagccaataacaatgaccaagaataaaacaacagcggcaacaacaaaaagccagtcactggcacaagcaataccattgttttgagttattatttgagaatcaacagaatcctccctatttttttctcctgctgacaacaaaaacggagggtaggccagttgggttcattggttgctcaataagaatcagagggcagtaactgcaagacaaggctgaagagggagtggtagaattgatttcagctgcatttcaataccggtttcatgttgaaatactaatttatagcatgataatatgatagcaacactgtctgcctggctgcaaagactggcctcttccagcttgtcaaagctgacagtcaagcgtaaaatggctactgtcaaggaatggcagctcttttaagactaggtcttaagccatttcttaaagttctgtatttctgtcatcactgtcccccatctcccaatcccttttctttctaaatgctagaataaactggctgcgcattctcctacctactacagcattcaccaaaagcctgtggaaaattcatactgtactagagcctggatatctacttttgatctctctcttctcttctcttctcttctcttctcttttcttctctatttcttttctttcttagctaataatgtattttaaaatgttaactaatcattttatgtaaaatcaggtgttatggtaaagcacattactttcatgacctcattaaattctcacaacaacctatgacaaaaatgctaccctgatttgctgatgataaaactgaggctctaagacataaagtgacttgcctgaattcacagagcctgtgatggcagaggcgggagtagtggaaaccagttctgcttgacttcagaggccactcctgtcattcctaaactggatatatttaatgctaaggaggcatgtctttttaagaatgtttgtacaaatattgatcgagtggaaccctggtgaaggaccttgcttggaactggacagtcaggttccctggcttcctccagctgcctcccaccctgtgggatgaggtggtgacaaagcccagaggatgtgcttgtctgggacgtagatcccttctgcaccacagtctgggacagtcaggcttgtaccctcaccactccagcccccaagaaaagcttctgcttatctcccagtagtcccatctctgaatggagcacctccccataactaaaccaatcactgagccgaggcaggggatgtggggtgctctgattggccaggtagtcacatgccccttcctggagttgtgaacgaagttaccaccatctgaatatggtagtctgagaataggagaaaggtcccggtacttgtcaggatgactaaggtgttgtgagcggaagcgggaagaaatgcccccaacacatgtccactggacttgtgaagcttccctgcctctcaactcctctgggctctgggggttgtaggagaatgtattaggaagagacacagaagggaatggaagataagagaaaaacaggccaggtgtggtggctcacacctgtaatcccagtacttttggaggccaggagtttgagaccagcctgagcaatatagtgagacccccatctctccaaaaaaaaaaaaaaaaaaaagccagatgtggtggtgcttgttgtcccagctactggagagactgaggcaggaggattatttgtcttcaggagttaaagcctaaagtgagctgtgattgtgccactgtgccctagcctggatgacagagcaagaccctgtctctaaaaaattaaaaggagggaaatacaaaagaatcctttcaggtaagtttgctcgcaaacagaaacacagaagtggagaagaatccgaaagggttcccttcaactcaagagagagaacacttaggaagaaatgctttaaaagcccagttcttggtggcaggcatctataatcccagctacccaggaggctgaagcaggagaatcgtttgaacccgggaggcagaggttgcagtgagccgagatcgcaccactgcactccagcctgggcgacagaggaagactctgtttaaaaaataaaaaaaataaaaaacagtcctgtcttattcccacatcccataccctgcagaccatacagcagtggtcttccacttttgtcctacagatacttacggctgtgggagggttcctcaggattctctgcaaagaatgaggttggggttcagaaggaagctcaatgggtagagctcacactctctcctggtttccaccagagcattctgtcattcgtcacccatttctgcatttttccgtaagaccttgttgttttgttttgttttttgttttgtttttgttttgttttgttttgtttttgaggtggagtctcactctgtcccccagggtggagtgcagtggtgtgatctccactcaatgcaacctctgcctcctgggttcaagcaattcttctgtctcagcctcccgagtagctgggattacaggtgcctgccaccatgcctgggtaatttttgtacttgtaggaaagacggggtttcaccatatgggccaggctggtctcgaaatcctgacctcaggtgatccacccaccttggcctcccaaagtgctgggattacaggcgtgagccaccgcacctgacccgttgttgtttttacaaaggccccttttctaaccattgatctacactgagacagtctcaagaataaagtcctctggttacctccacctggtgcttggtgtggtgcctgacacacagtaggcacttaataattgttgagctgtcaaatggaactgaaatgctgaatgacaaccagggaaaggtaattatgagtgaaaacttaagtcatagaaaggaaacagccttctgggcacacagagaactgatggtttccttcatgatggtatgaccatagacaaggcttgtgtacaaaggcagcctaccatttactgcatcctttttggctgccacaaagctgtaactaaacaggctcaatgtttgtgatgggccactggttaataataataacactctttgaacatttatcaagagctagatgcttgtgcattatctcatttaactctcataatggtcccatgaacggggatgttattattatgctccttttataggctggaagagattaagtaacttggccaaggtcacatacctctaatagggcaaggccagggtataaatccaccggtctgattccgaggtcccagtagttaagcactctgctacttacttaccaccagacagtgccgtaacggtggtcccgcaaaagtattttatggtttagagttcaggcaacaccagtgagaggaacactgataaactgaagtatctatcttaggaaaccagattaaagtgatggagggatggatggagaacctttgtgggagtctatttatcagggagaatgtaaagactctccaagaaaaagaagcaccttcaggtcccttggggaccatcagggaagcaagaactagatttgttttgggtagtttcaggcaaaacctagaaacatcatgttttctctaagttgacagattcccatacagtatgaaggacacactttctaacccagggcttctcaaacatgagtgtgcttatgtatcacctagagagcttgttaatgcacacacttctcaccccctactccccaaagagattctgattcagtacatctgggatggagtgtgacccattgcgcttctgataagcttctacatgctgccgttgctatgcttgggaccacactttgagtggcaatgccctagaccaggggtcaacaaactttctctgtaaagagcctgttgtagtttggatatttgtctcctcgttttgaaatgcgatccccagtgttgtaggtgggacctagtgggaggtgttttggtcataggggtccctcatgaatggcgtggtgtagtccctgcattgagtgagttctaactctattagttcatgaaagatctgattgttaaaaagagcatggcacccctcctctccctctcttgctctctgtctcaccgtatgacttgcctgttccctctttgccttcctgcatggtaaaagcttcctgaggcctcaccagaagcagaggctggtgccaggcttcttgtacagcctgcagaaccatgagctgaatacacctcttttctttataaattgcccagcctcaggtattcctttatagcaatgcaaaatggactaatacagagcctgaaagtgaatattttaggctcctggagcaactactctttcgttgtcatgcaaaagcagctatacacacaatgcaaatgaatgagcatgtgtttcaataaaactttatttacaaaaataggcagctaagcccttctgcatcagttagtgttcttagctggcagcaacagtaatcacttgctagtttaatgaggaaatgagttgcttacagcttccctttgggctaccacagagcctattaccactatcggctatgaccttgtccagtgttactgatgctttaagaagacccaagtcccaggccgggtacggtggctcatgcctgtaatcccagcacttcgcgaggttgaggcaggtggatcacctgagctcaggagttcgagaccagcctggccaacatggtgaaaccccatctgtactaaaaatacaaaaattagctgggcatagtggtggtgggcacctgtaaccccagctactcaagaggctgaggcaagagaatcgcttgaacctgggaggcagaggttgcagtgagcgagattgtgccattgtactccagccagggcaacaagagcgaaactccatctcaaaaaaaaaaaaaaaaaaaagaaaaaagaagacccaagttccatttctgccaagtcatctgctgcatcttagatctcagttggaagacagcagaagggtgtgttctgtctctgtgcctgtgtgtggctgacacacatgagcagctctcctctgaagctgaaagttgtctacgctcaagttactcacaatgggcaaagtatgatggcggggcattcccatcaagtgcattattccatccctcttgcaccatacacatcaacagaatctgccttatgcaagagctgatagacacagacagacatgcagggtgctgggagagccttgggtccaatcagtcaagtcatcaagtctgggacaaggagcatataattgaacccaactcaaggctaaactcaagttccaggaatgccagaaaatccttatccccaagaagcaagccttcatcaaattcagtttaactgttagtttgagtcatggtggcagaataacacttggttggttatgaagtcaaaaataatcccaaacgtggtctcttggataagagctggaaccctgggtcatgagggaactgatgtgtattctctttctagggaactccttgggctggtttcatctacttaaaaccataaccactggtaatctctctattctctctcatacacacacacatgtatgcttgtacacacacacacacacacacacatatagattcttactaaaggatatttgttgcagacactcagagaatctccagagaaacctggcttagaggccgtggattcagggacatcgctgaagccctgtgctggtggaattcccactactgatatcttgggccaggaactgcattctgggaaccagcactgggtatgggatgctattgcagggatctctgcctttgttatctctggaagctggacattcctactgctcctctctctgggatagattctgtgtgggaactagaggaaaagtctcacacagatatgactgaatggtggaccctaggccacacgcctctgccctctctgcaaaagcttctaggaaagaaagttttaagcttctgccacaacgtgggtaaacgcttcaaacaaaagaagggtacacagagaagcagagtgataaagagggattttacagtgcccattatacctctgaagacagctttttgggattaggttcaaggcatctagggcctttatccagtgttttttctacttttcccctctttttaaattaacctcaagtttcttccatatcctttatgttcttgagccctcaacacacacacacgcacacacacacgtcaatttctccccactaccagtccctcaggaagggcttagcttagtcataaaaatgaaacccaaattattagcaaagcaaaatctgcttctctctttcctagagagaaggaatccttcagttctcaaaaacacatggtagatagtttaaaaaaaaattgagaaagaatttgagttgaacaattcatattataatacaaagttaacttcagaccatttaataatcaaaattgcaaacaaattggtttgaattgcagcaagacagctttctggttttcaggcttgtggcaacatggaattcctttcctggaggtctttagggaattggctggatctaccaagtgggctggcataattatgtcatctttgggtgtggagatagagaagtggatcaaataaatggcgttcacatgtccctgctagccttgcttgaatactgttagtgtgtagtacccacatctaggagatggcggtgcaacgctaaacattccagcgaggacagactcacaagtgctcgcatgtctggcgggagaggcagaggtagctggaaccaggaacaaaggactgagtctggggttgggttaactactgcttattttattttatttatttgttttggtacagagtctcattctattgcccaggctggagcgcagtggtgtgatctcagctcactgcagcctccgcctcccgggttcaagtgattctcttgcctcagcctcctgaatagctgggactacaggcgctcaccaccatgcctggctaatctttgtatttttagtagagacagggtttcatcatgttggtcaggctgatctcgaactcctgaccttgtgatccgcccacctcagcctcccaaaatgctgggattacaggcgtgagccactgtgccgggccctactgcttattttatccccaatccaaccccaataagttttgcgattgctagagaccccgaaattgccagagtagttgaggagtactctaacattttctctgactcttagttaaacattggcaacttttccgagactataaatttgactggggcccagtcatttctctctttgtagtctgtgaaaattaactgagtctgcaggggctgcaatcaccgccaaaaaccgcaagtgtgggctgttcctccacactgacaaaaataacagctaattaggctgcaacaccccaaggaaagtgaacttacgccaccaatcgcaggatggcatgcaaaacgtcgccatggcaaccggcatttacagctcttcaattttaatatatcaaaggctaagggtaatttcccagcgagaatacaggagggtggatttctcccctctttattctttctgccggtcttttgccagtactgtgagtacggaagctctattcctgtggcaacaggttttaaaggaagagagccttgtgaaagcatgaaacacctggcgtgggactcctggaaatgctgggtgcctcgggaggcgcagggagaaaggcatggcattcttcttagagtctaggctgggtgaacagagctgagaggaggtgaagtgtgagctgtgaacttttgccctcaattgcaggtgaactttctgtttgcataaaaatgttttcttttctcccctctttcccctcctctgcccttccctcccctcccctctcctctctcctctcctctcccctctcctctcccctctcctctcctctcctctcctctccccgctcctcccctccacgctcctccccgctcctcccctccacgttcctcccctcccctctcctccccgctcctcccctccccgctcctcccctcccgtcccctcccctcccctcccctctcctcccatcacctcccctcccctctcctcccatcccctctcctcccatcccctcccctcccctttcctcccatcccctccccttcccctcccctcccttcccctcccctttcctcccctcccttcccctcccctttcctcccctctcttcccctcccctccactcccctcccctccccttttctcttgttggccctccctttcttcctccctcccttcttccttttttacctccctccccctttgcttttcccccccttccctccctccttccttttttccctccctccctccctgccttctggttttgttgagtgcttactctgcatcaggcacccaataggcatcgtctcatgtattcttcatcactacattgtaagataaacactattcttattttagagatgaggacattgggatgacgagtcctaatctcacagtaagttgtagagcctggatttaagccaagtcagacctcacaacccaggacccttgtagtttgtgtctcctctgtgttactaaaacttactctgtaaaaatggaggtggatatatttattaaagtcactgccatcaccatcatgagttggtcagtgctgcataacaaacacccacacaatcttagtggcatgcagtgaataagcatctactttgctgcaggataggatgactctgtgattattctgggactcaggctgaagggaaagtgcttctcacggtgatgatgttagtcactagagggtatgcccaaccacataagtgcatttcaaatctatcccatgtcatatctgctaatatcccattggccaaagcaagtcacgaagttgagcccaaagtcaagaattgggaaagcataccctcccttttgttgaagtaattgcaaatttttatagtaagggtgtgaacacaaagagaggtaaagaattggggccccagaatcattctagttcagtaactgtctatcatcatcatcatcaacttcatgatctctgtgaaccaagcttctctttacctttgtctgtgtttaaataatgagtgatctctttataaagttcttcaaagaggacagtcattcgattgaagcaaaataataattattattgagcacatactatgtcccaggcactgcactggggctacatcagtgaacaaaacatcccatctcaaaataacttactgggaaccctaaagccctgtgctagacattgagaagcccgcaagaaattctaacacatgccaaaaccattctgaatatttcacagaagatgtctgtgcatcaaaatcacctgaggaacttgttaaacaccaagactttcagaacttgccaccaacaactctaggtcatagggttaactctcaacctatcccattgaaaaccttgccccaaactacagttgagttgtaggaaaagaaagttacaggaaataaactacacgtacaccctcttctttggctactccttgggcaacaggccttgattaaagtttccagtaaatctcttccagtccccagcccccattccaacagtgttagtgaaaccaggaagttggagccacatgtgatgaggaaagacacaggtcccctcttcctgtccctctagggaacctcggagagatgtggggctccagtcatattctggttgggagttggagacaatttcgttgaattctaaattaccagactctttagtgagcgtcaggatcatcatgatgactctagaagggaggtgttacgaattctattttggcagtcaaaaatgcaaacactgagagaaggatctcactgtgatcacatagctaatgactgagtccaaatcagagtccaggtgttctaaattcttaggtttctatcctaatagcagcactgcccatgagctcggtgagctggggcttattacttaatttgaccccagtttccacattttttaaaacggggagtggtgcacatagttatcagtaatttccagagttacatatatgcaaagtgctcagcagtgtacctggcacatgtaataaatttaaccaacaaaccccagtggtagcagcatttacctgtgattttgttatcaacagataacaaaaagtaattatctctttacagttgctagagacatctcaaaatagtattaatgctcatcacttcttcaaattcacactaatttcagacacaccattagttcttgttatttagtaaattaatgagggagcacacttggcaagaaacgaaacaaggagtcttctggggggatggaaagatttcccatttctttagaagtgtgagttacagaaccatatccatttgtcaaaattgttcagttcagaactgcagactcgcatgtaaattttccctacgttgaagacaatgaaaaaagggcaaatgatgttttctgcaagtttcaggaatctataaataaattgcaaggccatgtttaaacactttttttagagcactttatagttgttcaatcatcaacagtattgatatgccaatttcaatgcttttttccatcataatctgtttattatagcagatcttctaaaggtttcttaacagttactgcactagaacactagggcaaatttgtattgtaaatgtaaattttgcatatattggagatttcaacatcttaaagaatggtaggatattgatgatcgtggaaggtgggaaatgggtgcatgggttcattatactattctatttattctttttatgttggatgttttccatgatgaatttttaaagatatttttaatgataaatttttaaaagaacctcatatattagtttatcacaacttaaaaatattgtgataactgtagttcaatataattggtttttttctgagttactatgcattttactttatgcatagtaaaaacccactttttctgagatgagatccctaggcttcaccagacaactgaagatttccttgacactaaaatatttaagatctcttctcccttttcatgctttccctgagcatgagttttcagcttgcttcagaatcacagtcttacacatttgcagagagctttacagtttacaaagtcttttcccccatcttcacgcgtcatctgcctagctgtggggacttgcagatggtacctaggactaaagatcaagtttccaaaagttgttcctttggaaaatgagggatttaccagaaatgctgataatcccagtatctgaacctaataagcaatctgtgagattaattagataagaggtggtcagttttactttgagaatgatctgaaaaataggcatttttaaaattaacaaaaacaatttctttgcatgtgctgaagatctacgtttgtaaacctcaaaatcttgaaaacacctcacttgttcagaaacaaatcaagattaaggaaaattttgaattatgaaatatattgaattatgaaatacgttatttcttttaggtccaaccagacattctaactaagctaacagaatgttgccctagaggtctagtgtagtaactttttttttttttttttttttttttttgagacggagtctcgctgtgtcgcccaggctggagtgcagtggtgcgatctcagctcactgcaagctctgcctcccgggttcatgccattctcctgcctcagcctcccaagtagctggggctacaggcccccgccaccatgcctggctaattttttgtatttttagtagagatgggatttcaccgtgttagccagccagtacagtctcgatctcctgactcatgatccacccgcctcggcctcccaaagtgttgggattacaggtgtgagccactgcgcccagcctagagcagtaactattaagaaacctttaagccaggtgcagtggctcacgcttgtaatcccagcacttagggaggccaaagtgggtggatcacttgaggtcagcagttcgagaccagccgggccaatgtggtgaaacccatctctactaaaaatacaaaaattggttgggtgttatggcccattcctgtagccccagctacttgggaggctgaggcagaggaatctcttgaacctgggaggtggaggttgcagtgagccgagatcgcgccattgcactccagcctgggcaacagagtgagactccatctcaaaaacaaacaaacaaacaaaaacaaaaacctttttttaacctgctataatgaacagatcatgatagaaaaaaaagcgttgaaattggcacgtcaatgctgttgacaattgaacaactataaagtgctctaaaaaagtttgtttaaacaatctcttgcaatttatttatatattcccgaaagttgcagaaaacattatttgcccatttttcacagtcttgtttgatatgtgtccctagcatttagtgaaacagctagtacaggtatatgctccataaatattgactacattcacgaatgaatggaaatttttggaaaggcaaatcccaattctggaatagctcagatggttcatagagtcagaatctgtgagttttccccgatttataggcagctctgcagaggggtggggcagatctggaataaacagaaaagcagcagatgaaaaggccattcttgttgcaatgacgcattggcaccatgcgattatttgttttctctaatacaatgtgaaaagtgctaatgggattagccttttgtgatgaatgctaatatgatatgaaaacaaatgctaatatgcaatgtgaaattgctaacaaaggagaaaattgctaataaaattcaatggacctcaatgacaaatgcttcatacatctccctcatctggccagggctgtctcatagcacagaaatgaaagtgaactggggagaaatgctagcctacgcgttgcttggtgagatgtggatttcagtcacttcctctgaaatgacctctgtgtgggtggggacaggagagaaggtacacgttggacacacacaaacatacacacacacacacacgagctccaagggctgaaggctccagctagaaggtatccgtacggaagctacaacatgccccatttctgtttttgtattaggcctttgaacttttccagaatgctctcctatcttttgcactgattggccttactgtaacctgtgcaattggttgggcagacacttagattctcaatcccccaaatggaaaagcagccacagagagaatggacttgcttatggccactaaaatagcagtgccagaactagattccacgtcttgggtccttcccttccctgcccaacttgccatttcatcctctccctccgtctcctcccctccattttccttactcatctccttcctctccatcactccctttcttctctttctcttcccttccccctttaccttctccaccccccatcatccacctctttcctctccctcttctcttttttctacttctcctctgtctctttgccatatccttctccatcttctctttctccaaaactgttggttcttgtcattattgtccaagggtcattggtataccagcaaaagctagtgattgtgaaaaaggactttggttggggagcagcccactttggagtgaaagttagagtaagaacctggctcagctactcacaaattctctgaagatgcataacttctctgagccttggttttcccatccgcaaaatgggttttttcaaagggtgggtgtgaatggttaatatgacaatgtgaactaaaattgtgactattcagaagtggtcatgtgtgcgggagaatactgggagggaatattgaaaagctagaaataggttattagggtgatttttttttcttcaacaatgtcctttattaatgtttcgtgatatttttatgattttcaacactttcaggcacaatgtcttcttttccttttgatatttattaaatggtttattttaaattattgtggctgggcgcggtggctcacacctgtaaatcccagcactttaggaggctgaggcgggtggatcatgaggtcaggagttcaagactagtctggccaacgtggtgaaaccccgtctctactaaaagtacaaaaaaattagctggttgcagtggcaggcacctgtaatcccaattacttgggaggctgaggcgagagaatcacttgaacttgggggaaggaggttgcagtgagccgagatggtgccactgcactccagcctgggtgacagagtgagactccatctcaaaaaaaaaataaataaaataaaataaattattgtggatcataattgaacatatttatgtggtgcatatgatattttgatacaggtaaattaatattttgtgacatctctttagtatcctgaaataaaattcatagattatataactcacagacacacataatttcataaaaatttaatgctctaatggtattataaaggaggtggaaggaaagtaatttatataaaataagtattttagtatgcaaatacttggccatgaacatagaagacatgctgaggtaggtagatgcttgtacctatattgggaatcaccataaatgggagagccacagaagcccactgatgcggatgtgttttattgataactatagtaccatatgtggctttgccagcagtggtgttgttttctgaattgatgcgcaacagctcgtcaggttctgaataacaaagtgaaatttacaattgaatcccagacctagaagtttcgttgtaaattaagaccgtgaaaaataactttgtgtttatgggaaaaattgagtttataagtaggtttttcatctacctgagtgtccagaatggcatttgaaagttaactaggatatggggcaattctgcatgggctgaggttgtcctctctaccacacggacctgaccctctaaatgcctgtagtgaccccctcctaccattttggcaacaaaaagcaacctcatacatttctaaaacgcctcctggggaggtaggatcttccctgctgagaccacagctatatttaaataataataataataataataataataataataataataataataaagcaaccaaagagaaaaccatcctctgctttgggcagtctttgacaagctctcggcttttttctctcccgcctccctctctctcgttgaggctaaaagtaaatgagaatggtggcactgatcccacatctagaaaattgaaaaagaattcatttttttttaatcatcaaacctgacagattaggcatgtctctcctgtcacatttctgtctgtcctcagagttgttgaacggaatctttccacggatccatgttattgctaataggatttgtctcagagtaagcattcagcctccccttgtttcctgagaccacagtggacactttcctcttctccctaagcccaaccttcattgtatttcagctaataaaataatttcctgccagatggtgggggaaaacatagcccctgggagaaatgatgttgctgtcatgaaagattggactggtcatgatgcatttggattaaagccagcctttccgaaggtgagattggcagttgggtttgcaacaggcagtcccatctgggcaaagtagacactccaggacatcagatctcgccggtggcaagtgggatttatttcatgcaatgggtccatgtaagtcttttcccacatcagtgttgtgtctgcttcagagttggggggattttcgtaggacttggaatttcaaagggaaaacatttggctcaagttagaatttaaggttcttcgggaaaaaaaatttctattcagtcctgtgatcccagccccagcctggaggaggcagaacccttcattccaagccattttcctgaattatattatcttctaagtttctttcaattccttatttgagactttagactaggtttcctgttctttagagtcttgaaggaaggtacagttaaggactattcctctctcctcaactttctccaaagtattgtcttgcaagagttcccatgattacttctaaccacttaaatgtttattaaaggcaatcaatcacttcaaagcaaaaatcttagatctcagtgaaatgaggttccttttgttccccatgacattctgctctatttcctctaggactcaatgttacacaaatcctgccactcatccttgaaccacaacttaatcactcatgcaaaaattaagattcgatcacttgtgtagaaattaaactgaccttttcctttacctgtaaaatagaggcaatactagcattttcccttaggagaattgtgaggattaaataagattcaggtgtacaatgctcattgcagtgcctggctaataacaagccctcagtaaactgtcgatctagcttcatgttaaacctgtgcaggaaatctcatcttcactcaactcttgggctccaagcatcctagtccaaaagttgccccagccaaaacttaggattcttctcttttgcttatgctctgtgcatctaactcattggtaagtgcagtgagctctatctaaaaaaaagtctgagtccatttctgtttcctgatctctaccaccaccaacatccactttcctcctccaccttccattatcttggctgtggcaattacatcctaattgatctttctattttgactcatggctttttaaaatccattttcttcattgcagctgagtcatcttaatttttttttaaatttaagttctgaatgtgcaggtttgtttttaatttaagtgcattatgtgcaggtttgttacataggtatatatgtgccatggtggtttgctgcacctatcaacccatcatctaagttttaagccccatatgcattaggtatttgtctcaatgttctccctcccctttccccccacccccgacaggccctggtatgtgatgttcccctccctgtgtccatgtgttctcattgttcaactcccacttatgagtgagaacatgaagtgtttggttttctgttcctgtgttagtttgctgagaatgatggtttccagcttcgtctgtgtccctgcaaaggacatgaactcattctttttatggctgcatagtattccatggtatatatgtgccacattttctttatccagtctatcattgatgggcatttgggttggtttcaagtctttgctattataaataatgctgcaatagtcatcttttaaaaattgaacttttgtcacttctttctttaaaactaccagcggctccccatgcctcttagaaataaatttagactctgtacccaaattttcatgatttcatgtgatcagatccctgcccatatctacaatctcatcttgtgcttttccttttcttcatcacgttcctgctacactgctcctctgtaagagactcatttctccctccagactttgaacttggatttgtgaacccagaattatctgagacaggtctcaatcaatttagaaagtttattttgccaaggttaaggacacactgtgacacagcctctggagatcttgatgacatgtgcccaaggtagtcaggatacgggttgtgttcatagattttagggagacatgagacatcaatcaatacatgtaagatgcacctttgttctatctggaaaggtgggacaactcgaagcagaggtttcccagtcatagatagacttaaagattttctgattggcaattggttgaaagagttattatctaaatacaaaggaatgtctggggtacaataatgggttgtggagaccaaagctgtatcatgcagatgaagcttccaggtagcaggcttctgggagaatagattgtaaatgtttcttatcagacttaaggtcggtgttgatgttaatgctggtcagcttttcctgagttccaactggcctttccattatggcctgaactagtttttcaagttaactttggattgcccttggccaagaggagggatctgttcagatggttggggggcttagaattttatttttcatttacaagttctttcagcctaggaggactttcctttggatcctcctgtggctggtttattgtcatattctgccttagcaaaattgttacctcctcaggccttctctgcccacctacctatagtctcatgtagctatagagtgacaggcatcctgctatagtcacttgtaaggtgatcatataatttattattcaacctggagcacttataaggggtaaaaggggacttttactccaattcagccaggatggtgggtttaaagcaggatagtcctggatgaattgagatgtggtcagccttcctgtttatcattcacaccttctctatatcaccatgctttattatctccatagcccttgtcgttagctgatatttttatttatgtcacaggtcaaaccccaaaattggggttcagtccagaagaccacatgggctcttggcttcacacaggaaggaattcaagagccagtagatagttaagtgaaagcaagtttattaagaaagtaaaggcacaaaaggacggctactccacaggcagagcagtgatatgggctgctcaactgagcatacttatggttatttcttgattatatgctaaacaaagggtggattattcatgagttttgtgaaaggactagggaattcctagaactgagggttcctccccttttcagactacttagggtaacttctagacatcgtcatggcatttgtaagctgtcgtagtgctggtgggagtgtcttttagcatgctaatgcattctaattcacgtataagcagtggggacgaccagaggtcacttttgtctccatcttggatttggcaagtgttggctggcttctttactgtatgctgttttatcagcagggtctttatgacctgtatcttgtgataccagtcctgctgacctcctatctcatcctgtgactaagaatgcctaacctcctgggaatgcagcccagcaggtctcattctcattttacctagcccctattcaagatggagtcactctggttagagcacctctgaaaaagcaggaaattgctggaattgagggttcctccccctttcagaccatatagggtaacttccagatgttgccggggcatttgaaaactgtcatggcgctggtgggagttttctttggtatgctaatgcattttaattactgtataatgagcagtgaggatgaccagaggtcactttcatcacatttctttctttcatcaccatcttggtattggtgggttttggccagcttctgtggtgcatcctgttttatccgcggggtccttgtgacctgtatcttgtgaaaccagtcctactgacctcctgtctcatttacatacttgttatctcttggcttaatgtaaactttaagaggaggaggatattgtctctctggttcaccattaaatcttcatcttcttgaatatgtttagcaggtggtagagattctataagtatctgtggaataaaatatgttgaatgtcaggtcctttgattgttgtaggttaggtagctatggattagttttccttgctacacctcttttgtcattttgaatggtgactcgtaaagcctgtctttctgtgctgatcaggaatcatgttcttttccagaccaggagattccaaccaaaggtagcttgtggagcaaatagggcttctctgaagtttcttacttccctttagtggcccccttgtttgaattaggtttgataagcacaaagaaggaaatagttccaggagtaagagacacttactcagcctgcatagaagacgtcatagtttcccagcagtcagggccataaaataagtggtctccctgcttatggactggaaatgccaaaaatgcaatgttgaaaataataccgcaggatcactgaattaattattgtgggtcctgattgtgtaaaatctgattattgtggagtggggattggattgcatgttaatatttaagtcctttggaaatggcactgaaggaagaaccctcccatactgtttggttcctccagcccatcccccatgagacaggatttcttgggacccgaacagaaatcaccttatcacatcagcacagattgcaggcagggcttgcacttgcactatttgcatttgtataaagaaagggcctggtattatgtaactgcatgtgggttctgagggcttctaatgggcctccttttgtacagtctcttagcaaccaattgaagtttgtaagctgaaacaaagagactggagtccatcactcctttagcacattcctctgagtctggcctgcctctaagagagccagcctagtggaggcataccttttcttccttgccaaagctcagcaatccttgttcaatcattgcttcaccttaggaaggaaaggagttgagagttggggagataggctagggactagttgtgttgtgcttagaacttcaacttagtcaagtaaagtctttaaggcaactgacctgcactcattcattcttaaaagaggcaatgttacttgacagttaagagtgttctttagggtcagaaggaatcctggctctgccactcaacagctgcatgtccttggacaaattacattatatttctgggcttcagtttcttcattttgttatgcacgaacaaaaaaatgtacccttctcattggttcactgaaagtattaaggcacgttattaatgtaaacaaatattcagggttggggttccctatgtgtccagtactgtccttggtgctgaaggcactgaagtaaatgtaacaggcaaaaattccctgctcatatatgcaaggataacactatggagggagatagaaaagctgatggtattaatgacagcatcatggaagatctcactgaaaatgtgaccactgagcaagacttgaaacacaatcccaagtgaaggccttaacatggtgcacaaaggttgtaaatgctaagtacatgttagcttttatttaatttattcactaattaatgtcgttattcatctacttatttattcatctggctaattctgaattacttactcatccacctgtccattcatccatccacccattcattctttcatctgacattacctgaaggatatgaataatattatttctatattcaacataccaagtgccataataaaggcagatgtagatgaggtttagagcaaaatttcttagcttcagcactactatcatacctggtcatatgattctttgtgtgtgtaggaggggttgtcctgtgaattataggatgttgacagcatccctagcttctgttcactagattcccatagtactcccaagccgtgacaaccaaatatgtctccaaacattgccaagtgtcccatgggtagtggggtggcggcgggggaggaattgtcttcagttgagaatcccacatttagaggaacacctttctcaggaaggaaaattaatctactgcatttctctagaaaggaaatgaatctaagactttaatttcagtagaaataatagcattttccaacattttgtttcttagaggcatattttcttgtgctgaaaagcagaagggacttggggactatttgaaattgaaaacagaatcttaccccacaggaactctttgcattgcctttgagaattgtggctcattcaaaaaacatctccaaggcttaccgaagaagtggttacaacagggaaatcttcactaacctgaaggaatgcaggctcatgcttggtgcctttggaattcttgcctgattttattgatgactccacaactacaaagctcagcccaagattcctcaatggaataacaaacagcaagactttctctctaaagaattctgttgagagcagccacgtgacttgattccttggaaaaagaaccatgccttacagggtatcatgtcgaggccagagcagccatctctgcctaagggcacctttccaggtcaatctcttccaaggacagctcctgactactaggaaggtaacttaacttgcccggtttctcactgccctgcatatatctattcctggagacatctatggtgcaagcaagttgtctggaaatcctgcagtgtcttaagcagctcttgaattttaccatttccccccattcccactgtatctcttctttcctcctctcccatcctggtcaatcaagtcccatttggtcaatcacggtagctgaataactgttcacctcattcctatggagggttgctcacttccacctgtcctctgcacagtagagttcagtcttttcactaaacacagacttcagtgccagctccgagtcctggcctgcagggtaatgcatgatctgcccttctctccaacttccacaccaaccgctctcccttcgtgctcaatctgcttttgtccccccagcctccttagctcatttacactttaagacgccaatagggttatcttatcccctcccagcaccccccaacaccagtcaaatctttgctggtagcccattgttttgtggctgagaatcctaacaaggcttccaagtccaccactgtctggttcttgtctactgtaacaccatcttccactatctcccatccctgtggtccagctgctgtgtctcctctgcccctcatgtgcacagggctcttcccacactagggcctttgctcatgtgactatctccactctagaagctcttcccttccctgcatgctgtttaagccttcaccatgtatcaaagctcagattcagcctctatttctcatgaagacttctcttacctccctgacaagttcctgtgccctgattatacattcttatagcattatattctctcattcactgcttcctagttgcaattttatatttatttacaagcttattatattatcagctctcatctatccagtttctaagcacctcaagaaatgggaccatatttgttatgttaccattttgaacttagtataaagtgcctgacacatagtaggcactgagtaaatattatatagttgggaaattgaataaatacaccccagcactcctcaactacgaagacttatgtttgcaaaattaggctaacgtgagcttttctggagccatgggggaagggttgaggatggaatagactagagaatttgtaactggggaggtatgagggcaggtcagcatcaggaaattacatcacttgacattttcttactcccttttgtgtctgtaccttcatcttatattatccaatattacaagccccttgaatgtaggcatagagccttttatttctaaaactacagtgagcacctagcccacgacctggcatatagtaggtgcttaacaaagctgcactgaatgaatagatgccacgcattctagatttaatacagaccttaccatctaagctgaggttcattcaggagggactgggaaaggaatgtgaaggctcatgattgttatttatttatttatgagatggagtttcactctgttgcccaggctggagtgcagtggcacgatcttggctcactgcaacctctgcctcccgaattcaagcaattctcctgcctcagcctccggagtagctaggattatcggcatgtaccaccatgcccggctaatttttgtatttttagtagagatggggtttcaccatgttggccaggctggtctcgaactcctgacctcaggtgattagcctgcgttggcctcccaaagtgctgggattacaggcgtgagccactgcggccgatcgttatttatttattcatttatttgagacagggtctggctctgttgcccaggctggagtgcagtggtgtgttcatatctctctgtaccttcaaacgcccggtctcaaatgatcctcccacctcagcctcccgagttgctgggagtacaagcgtgcaccaccgtgcctggctaatttttaatttttttttttttttttttttgtagagacagggtcttagtatgttgcccaggctggtctcaaattcctgacctgacctcaagtgatcctcctgccttagcctcccaaagtgttgggattacaggtgtgagccaccgtgcccagccaagatggttatttattaggaaaacatggtacattgaagtttttcacaaaacatacgacagaaagagcctggatagtttttctttttaagctaacatttatcaagaacatatttttttttttgccagccctgtgataaacgcattatatgcattatctagttaatttgtagatgctgctaaatttgcagatgaggaaactggggcttggagacattcacttatcagtctaaggccagagaatagtggcaaaattagcattcaaacttgggcctgattttaaaattcatgggcttagcaagtttgctacaaggactcttgcgctaactctgggttcataaatgagtcatccaacaccttttgccttcatgccctcacccattggatagatgaatccattcctactcacatctcaaggctaaatgaaagaacgcgtgtttgtgaacaggcatcagaatacatataactggaaggggtgccataattcatttattgtgttctggctccccaccagcctaacagggcctgttattatgtgacctcccattgcttaagcctctgataagacagtaagtctgtatacaaggtgaccatgaactgctacctgctttccaattgctgttggaagagctccttataccttacgaggctaagaagatagaagaggtatttcgctctggttttgagcaatttgttctactctgtgaacttctgtgtctgcttatccagtttcatgaaaattagattaacgagtactaattggtgctgactccgctagcttaaaatggatggtgtcaaatggaagaggagcccaccagtgtgatgtttggatcccaaagctgctgggaattaagtttctgcatggatgtcgatatcataggttacttgtggcagcttgctccaagctacttttatggaacacagtgtcacccccacagatctttgaaaggaggaaggatgctttttccaaagaggatttgcttcagatgatttggtcaaaatgctcattcattcgaggaatcttttttgagcacctattagatgccaggctctgttttggactcaggggtaccagtggtgaataaaacaggcaaagttccatccacattaagcatacattctacctaaggttggtagacaataatgaagtaaatatataatgtcaagcagcatttccatctgatacttgtatattgattaaatatgagataaacacatattttaaaaatgctttgttgagatataattcatataccatagaattcatccattgaaaatatacaaatcagtgggttttggtatattgagttgtgtaattatcaccacagtcaattttataacattttcatcactccaaaaagaaactcagcaatctttagttatcaccctcctataccccataccctacctccagtcctagacaaccacaaatctactttatatatagatttgtctattctggatagagaaaatatcatcttttgagagtgaggaggcatgggaggagactttactgtcctcacctcccagatgaggcattttggatttagttttccttggagctccctctaagatccagacttttaatcgcttcacaggctcagtttctgggggatagtaggggtgctggccagtgtcctgatacagatcctcttttttaccactttacctttcacctctaagtcctacttgagataacaggtgcagagccagtcagcaactgagagtaaatatgcatatatggaaacagaagacactccagtcagctgtgcagtcacatctccaagcaataaataagcacatcatgtttatagaagcctcactgtagtccaaattactgtaatctcttacctggactgttttagtagcctggtctccggtctccccatgtttcatcttgcctctctttcagcctgttcttcccaagataccacaataaatgtttcaaagtgtgaatctgtccatgtcactctcatgctgatgaaaatcccacatagtcctcaaggtagtcaaggctttcctttatagcccctgagggcctgcaaaacctgatccctggaagcctttccggcatcatctgtcactattcttcctccagtgtctaaatcacttttaattcctgcgaagtgtcacataatctctagccggcctttgccctctctggaacattctttcctacctgcattgcctgactagcttccatatgcccttcaggtcctagattagagatgacttcctttagtgggaggccttccttgtttcttcaggatgtggttaggtacctgtattagctttctactgctgcttaacaaatcaccccaaacttaacaccttaaaacaacaaacatttcacattttctgtgggtcaggaattcaggagtggtttagttgtatgcttctggatcaaggtctctcatgagttgtagtcatggtgttggccagagctgctgtcatctgaaagcttgactggggctggagggtctgccttgaagatggtacattcccatgggtgttggcagagggcctcagttcctcatctcgtgggcctcttcataggactatttaatgcccttacaacctgacagttgacttctcccgtgataaggtttgtgtgtccccacccaaatctcatctccaattgtagctcccataattgccacatgtcatgggagggacctagtgggaggtaattgaatcatggggacagtttcccccatactgttcttgtggcagtgaataagtctcatgagatctgatttttttttttttttttttttcctgagatgaagtctcactctgtcactcaggccatagtgcggtggcacgatctcagctcactgccacttccgcctcctaggttcaaacgattctcctgactcagtctcccaagtagctgggattacaggtgtgtgccaccacgcccagctaatttttatatttttagtagagacggggttttgccatgttggctaggctggtctcaaactcctgacctcaggtgatcagcccgcctcagcctcccaaagtgctgggattacacatatgagccaccgcgcctcgccaatctgatggttttataaaggggagttcccctgcacaagctttctcttgcctgctgccatgtaaggtgtccctttgctcttcctttgtcttctgccatgattgtgaggcctccccagccgtgtggagctgtgagtccattaaacccccttcctttataaattacccagttttgggtatgtctttattagcagtgtgagagcagactaatacaccccagaatgatcaattcaagaaagagttgggggaagctgcaatgccttgtatgccctggcctctgaagtcacacacttctatcgtaatctatttgttagaagcaattccagtcaatccatctcacatttaagggggaagaaaactatgctctacccattgaaagaaggagtttcaaagaattggtgaacattagtgacccttgtatcctgtccttacagttcctgcacttacccctaaattagctgttagcacactgagttgtcattgtctatctctttgaccatgagttcttcaaggatgaagacttacttcctttcacaatatttagaatatttctaaattctgtcacagttccttaaatactgtttagtaaccacttatttggtgaatcaatgacctgttctagatgcctgaaaggtatagatcagtgcttctcaaacattaatgggcatccctgcaaatcacccaggtgtcttgctaaaatgaggattttgattcagtaggtctggggtacagcccgagactgttttcctaacaagctccaaggggatgctgtgctccatggagcacactttgagtgggttagggtttagaagatatgatcccatttctagataagcttcataacccaactgggaagacacacttcccccagtagggcagcccaaggctggccatgaagtagtgtcagcctagtcatgggcaaacctgcagtatactggactcgctttccctccagcagccctgattgattgaagagatgtcagtgaaggacagtcaaggaagggtctgtgtgatataggaagccttccaagtaggcagcatattgtcatttggctctggaaggtagagctgggcgggggccactcatgtatatgccaaggggttgcatagcgtgagcaagggtggagggaggctgagtcaactccttgggggggatctgaaagaaagctggggttgagtggtggcaggtgatggagtccccatctacacctcagagaactcatgagcccagactgtctgctgtggttgaagcactacttttgctggaggaaaagggttagactatgaaacgtatttgtactattcctgccagttcttgagatatgtgattctaaggctcatattttagagaaaattgagcaaatccagatgttttctgttcataccctgaatctcaccttcatccttgctgttctgattttaccaaggtgaggcacgtgtgtgtgtgagtgtgtgtgtgtgtgtgtgtgtgtgagagagagagagagagagagaaatctgtcatctcaagtggggcattgtcttcttatcacatgaagggccaatgtaagcgtagggtaataataataatccccaatgtttggggaaaggtttcacatccatttagtctagtggtgctcagctgtaactgcacattggaaacccctgtgagctttaaaaattactgatgccagcagggcgcagtggctcacgcctgtaatcccagcactttgggatgccgaggcgggaggatcacctgaaagaacagcctgaccaacatggtgaaaccctgtctctacaaaaatacaaaaattagccgggcatgatggtgggtgcctgtaatcccggctactcaggaggctgagtgggaagaatcgctcaaacccaggaggcagtgagctaagatcacaccattgagctccagcctggacaacagaggaagactcagtctcaaaacaaacaacagaacacctactgatgcctgggttccacctccagagattctgatttaatgggtctagagtgtaagttgggcatcagaatgtttaaaaccttcccaggtgatgctactgtgtggccatggttgagagccactagtttaatcttagatgaacccttcactaataaaggtaagggttcatgtaagattaaactagtggttctcaacaactagataagatgacctgtctttttttatttttaaagaaatgaaaaaattgtttttcagcaagttgagtgactgcttgaaattcatacaaccaataagtaggaaggtcagaactcaaactcaagttagttggttagtgctcgttcaatttgcattaccaatgttgcctccaggtagctagtattatgcacatgacaaaggaagagaacttgaatttagatatctggttaaaggtcagactttgagttagggtgtagttagggctctatatttgtttttctgttttttgttgttgttgtttgttttttttactataaatcagtttattgtggttcaaatagataaactgacattcaaacatcttaaactttaggaacaaaagtttaacatttaaacagaagtacagttttcaggaaacatccagaaaataatttgttatctaatccagagtactgacaaagatttcttcatgataaataaagtgtgtttcaccagcagattttttttcttttttttttcattccttcataaaaatcactggcagtttgattcagaccaacttcctaatgactgtggctctgtaccttagaggaaactgctaaataaatcccttaggttaaccaatgagattggcctataattcagagggtataagcaaagcatgtaagtgaacaaattaaattgttctttagagatgatgtaaaagcatgtccattacagtaattttcgcctctgacagattattcaattttcagtgttttacttttttctgggggtgggcagggggtgatgtgggagggaagggagggtcttgctctgttcccaggctgaagtgcagtgacatgttcatggctcactgcagcctcaacctcctgggttaaatgcaatcctcttacctccgcctcctgagtagctggaattacaggcacacactaccttgcccagctaattttttaatgttttatagaggcatggtcccactatgctgcccaggctgttctcaaacacctgggctcaagcaatcctcccacctcagcctcccgaaatatgtggattacttgtgtaagccactgtgcccagccttacctgctttaaaacacaaacaaacgagcaaaaaaaaaaacccaaaaaaaaaaacacttaggttttcttggagtctgtgctagttgcatcttgcaaatgcaaaccatataatgctctttaatgaaaacctttccatgcacaccactgttaggaagagcatcattaaatcactgccttctatacccataaaaggatgattttgagtttcaagttaaatttactagagatagcttgtatatatcaatcatgtcacaaaaaaatatttccaaagtgttctctgttcataaatgtcacaaatgcttctcctatttgtcagatcattttgcaacaggttaactaatacttatctacataaaaacctgaaaattggcacaggcaagcattttgaattagtagattacccccatggaacagtattcagacttactttgtcttgtgggctctgaggctctgggaggtagaggtggaccctgacagtccaggtcatcaacatccacattcagttgaagcctctcctcaggcacagtccagtactgaataccatttatcattctgcaaaatgttgtctacatctttcaggtgctggtcattcttagattagcttcttagctgttctgttgacgaacagaagacttcaattttcaggatggatgttccagcatcttccacaagctttcactttcacatttttcactaaattatttgttataaatttgatctccttcaaaagtcccctgaagtcaactttggttgtaatgtatttgtctctaacgtattcttcaaattctctttgttttttttcctgtcattggaggagaactgcacccagaatcttatttttactacttccacgtgaatgttaaggtacacacagaggtttcatccagaagtcttccctcttctttctgttaagtacttcaatgtgctcattaagcttctctttctcttccctttccaacaaagatctagattccaagtagtgatctttttgatgagtcctctatcaaactatgacacatgtgaagaacatacctgaacaaccctcagggataatgcaggattttttgagaaagttccagggtatctcctggtgtcagtgtactttcagtcctacacctcagagttttttctttttaataacagctttattgagatacaattcataccttacatttaaaatgtatgattcagtggatttgagtatattcagagttgtgcagcctacaccacaagctaactgtaggatattttcatcaccctgaaaaggaaccctacacccattagcagttactccattctacctacagccagcctaggcaaccactaatctttctgcttattctggacatttcatatgaatggaatcatcatgtgatattttgtgactggcttttttcacttaatgttttcaaggtttatccacgtttagcatatatcaatcctttgtttctttttagtgccaaataatggctatgggcatggggtagaattgctaaatcatacagcagctgtttcatctttcaaggaactgacagtctgttttctgaagttgctacaccattttacgttcccacccgcaatttctgtacatcttcaccaacagttactattatttctctttttaactacagccattctaatgaatgtgaatctcagggtttgttttgttttttgttttttgtttttgtttttgttttttttgagacagagtctcactctgtcacccaggctgaagtgcagtggcacgatctcagctcactgcaacctccacctcctgggctcaagtgactctcctgcctcagcctcccaagtaggcgggaccacaggcatgcaccaccacaccaggctaatttttgtatttttagtagagataaggtttcaccatgttggccaggctggtcttgaactcctgacctcaagtgatccacctaccttggcctcccaaagtactgagaccacaagcgtgagccactgtgcccggcctcatagtagttttgatttacacttccctaatgattgtgtccagcatctactggccatttgttagtggttttttcttctttaaaaaactgctgagacatccataaacattttcaaaatgcagggtatgtttttcagtgttaaggcaactgttttgatgtgttttcctttgctctctatcaccaaatactgtacatacaaatagtaagactgggctttgtgttgtccactgtcaatcctaaatgaaacaaaatacatggagactttgaaaatccgtcagaataatgctatagttaagattttgctaaagcaagtgttttttctaactccttgagctgcatattgccttgagtaatcatcaaccggattgtatcctcttcggtggcagttttgtttcttctgaattcttcccttgcccagtccttcaggtatttgcaatcagaatcatttggaacttgccaaattgtttgcaaaatccttctgtagaggagaagaatttgttgccttcttatgaacgtgggcactgggcagctgaggcaccgggactcagggacatcaagcgcctgatgcatctcatgcgaccgcaccaaaacccagggctctatatttctaatgtccctgtttgctcttctcctgtttctttgaagccaagtttgggccgatacccatattagattaataaatcctaggctccttgatgacaaaggtgatattactatctgctgatccaaaccatgaatagtcaaggttgaaaaatgaaattggcaggaagaagtgtactttattggacccaaccttgcaatgtcaatgttcttagttctgagaaattcttgctcctggaattcatccagtttcatctttggatacctgcaacctccctgctcacaactcattcttgattaaattagcagatgctgatgatagaatgagactgaggccagtgatgctaaaataatttcttgctggtgaaggaggccccagaggttttacaaaaaaatttttaaaagcaccacctagggaatagagccaaaatgctcagacactgcatggaagccagggattgtattaaatccgagtaattggagtggagagggagagtgttttgtagtaattgtcatcatagctggcaccagatctcctctcaggtaagaacatagaagcttggaacttacgagagaacttagctttccagtattttttaggtgtggaatgtgaagtcatgaggggggctggtctgcgaagagtcagcaaggtgaaaagagataacagagtgtcttgggaggtgcaggagagcagacagaacaggcagggaataaagagagggagatggaaacgtgtctggaagctggaaattgcccaggcaggtggccattgagagatttctaaaacttctgagaatgggggtatgtaatattctaaatcatttgaaatcttatgcaatcctttatctgaatgccttgatggaatctgctttctacatagctctacaattgtattttgaggaataaagggaccagggtacttattagggagaggtcatacagtgcagaaaggagaaaaaaaaaaaagaacttgcagaataaaggggtgatctgtaaaatgaaccaattcagtggaaatgagacccagggttgtagctgaagttgactccccaagaccctccaaagagattggggggcaatactgtgtctcccacagtttggggtgttttgaaaaaatctcatttaaatctctgaagtcaaggtgatgccactttgtcgcaaatggagtcttcaggaagatatccagtctgcaatagcaaatgtggaggccagactaaatggaacgcccctgaggaaattatggatgtagcagcagtccagttcacacgctcattcattcattcatcaaacactggcacaacatcttacattgtcaaggcatgtaatgtgtgccgagaatatagacactgtccttgccttcaaggaactttcacctttggagtgagaaggcgaaaataactgatatttactgagctctttctgtatgcagatactaggctatctatttcacaggctttgtctttttaaaattctcccagcagctttataggtaattattatcccctatacgtgtgtgtgtgtgtatatatatatatgtgtatatatatgtgtatatatatatgtatacatatgtgtatatacatatgtgtatatatatgtgtatatacatatatgtgtgtatatatatgtatatacatatatatgtgtatatatgtatatacatatatatgtgtgtgtatatatatgtatatacatatatatgtgtgtatatatatatgtgtgtgtgtgtgtatatatatatatatatatatatatatatatatatatatatggaatctgaggcccagagagattagggaatttgtctcaaatctgacttagctaatctatgataaaaaaacaaatgtttggacacaggattatctgacccttaagttgggggaggggttcttattttggtcagaggcaattgaaaattggcagtaggtggatcagtctggatgtgtaatttggaaaatattcccggtgtttttctggagtctcacctaatctgctctgatgcctaatagcccgtccgttaccagtgctttctaacacagggttagccattgctattctcatcagctctatgtttagaagcttaacgcatcgactcagcaagccacaaacaccgtatcatggatgcgctggctagcacgagcattctgtgggcctgctaaggggacggggcagtggagagcgcagtgtggagcctggaatactgatgctccagaaacgtggagagagatgccgctcttcatggcaggtacgcaggccttgcttcctgcagcaagttaaaatcatccaccatcattagcaaagggctgttacaagggcctttttaaagtgtcctgtgcccaggctacaaggagcaatccatcatgttccataagcataaacactccacagctaattaagtgagggtgaaatcatctgcaccatccatgtgatatttatttaaaatgatttgcttaagataggcccagagtccttctccttagggaggtatagaggaactgggaggagaaaatttgggcacttgaggagcagaaacgaattggactggcaagcggagaagccacctgggcctgcagttggctgtggcagtgaatggacatctgttgtttttgtctgttcgacaccatcctctcccgccggggatccatttctcttctactcctatcatgtaatggggatggggctgccaatcacagtttaccgtccaatgccctggtcgcaggggtcagcataccatccaggttcagccaatcgtagtgccttgtttgcctgatctgagtgataggtccagagttagagccagcccttttggcagtgaggacaaaggacgttgatatttttgtgttatggagttcaaaggacaagcagcaagaacttctggggccttctttatttaccatgtggaattagctgtctgtaggagataatatcaaacaaaggccagcaaaaatggaggaagagagggctgtgagtattggggctccagtttcagttcttgagtcccctgagtgctgtcctagttcttgtaatttgcgttttaattgttgtcttctaacgtttcataacttaatacattccccttctgattacacgtctgtgaattgggttactgttacttgaaagtgaaagaaccttgactaacatagatgtgaacatcaacaatcacatcttgggaacattttcttgcatggagctggcaccttaacatgttctgtatttggtgctgggtggcaattggactgtacacttacacgtctgaacttgaatggaccccaggtatcaataggccccattctcccatttatttggcagttgagggggctgagactcatcatggaagagagactcgccatgatcacacagcaaatcagtggcacaaccaaagctgtgaagggcctgggcctcttggttctcaggccagtactccctgtcagggttagggctgatgatgtttccaggcagagcagtggaacaaatgaactaactatgaatgcacaggatcaagagtctccaaaacatgtcaggccagccatacctcctttttgccccagctctaagtttccacccttacaacttgccaacaccaggtggactgaattattcttggtttggtctcatgctcagagacccagcctagaactcaactttcagcaccttggcagcaaggcctcaaagccaaccgtacaaaaagcctagatgttttcaacatcggtgtggtgtgacttcaaagcatggtcatctacgtatcccatggagccatgaaagaggcgggctggtgggggtgggtgcacttgctgagacaaagctttctactctcacttcacccagggcacccctcctaatcacccatttttaagtctttttttttttttaaatatatatatatgtggaggtttaaggtacactgcttgaaaaagcattccccttaaagaagaaaaaaaaaactcttaaaatcacgaatttaatgaacttaaacccagtaaataagcaggaaagaaattccaactgacccttcagtaggcccagaaacctcattattgaaggtaaaaaatcacagcttactttacaatgacccatattttgacaaatactatccatcaaatgatggttttaaagacagaatcttggacaaatggccccatgcccatattgttaattaattaagatatatggtctcattcacttgtccgttcactgaatattcactgagtgcccatacgctggactcactgtgctaaatactggaggtaccacagtgaataagataactgtgatccttactcctacgcagattttagaaatttattcttcccttgcaactgaactcattttttgaggaattatctccgggcagaggaaagggaagttggctgtaagatcaggctggaaagaggttttgacaaatgaatcttgggtccatccatctgtctaaatatggagtcagtcaccatctctcctgagccaagctcaaggaggctgaagctgacacagctctccatatatttgcccctctgtgtgtctaatggggagatatctagcctattttgttctagctgctaaaatcctatctgtgtctcagtgcctgtcttcctttaaggattttgaagggtgaattagaagcatctttacaacccaggcatctaggctcccaacccctgggcatagccctcagaaaccacatatatacataatagtgagctaacctcaggggtggaggaactggtcttcccagtgacttatgaaagtctcattggaagatgggaaactttggttctagacttgaccctgatgaccatgggtagcttcaggcaaatcccttcacctgtctggctctctactttaccgactgagtgaaggaaccaaaatgtggattttcccaaagaaacatttgaatttccatttctgattggattaattaaggtaaggctagcctgctgtaattgaaagtctcaggggcataacaaaatacatatttatttcttttcatgtcatagtcaataggggtgactctggtcaagcattcttttatgtggctatgcaggggctcagttaccttccaaactgtggctctgccttcctttaaggtagaggctgtgcaaagtttccaaaaagaccacctgaataggccaagtggatgaatgtacaaaatcaaggtgattcaaaacatctgagctggcaaatagggaaagattgagagaggagagactccagtgggaggttttagggaccagggctagaggtgccatgtacctattctacctacattccattggcctgagtcagtcacatggccatggctaagagcaaggcagtctggaagatgcagtctagctgttccattggcctggtcacatggtcacagctaagagcaaggcagtctgggaaatgtagtctctgtggtaaagaggaaaggaaaacacgtttgccaaccaaccaaccagttgggtataggaaactgcaactttccatggcagtcccttcttgttattctctactcagtacgggtttaaaaatcatatacttctgcctcaaccaggaggtacttataggaggttgttgctataatccagttagaagatgacagcagtttttatgagggaaatgtgtccacacacccaggttttcccaggataggccatttatgcctgcagtctcagcatcccatccacgtggtgcttcctttaactctcaaaagtatcccagtttggatgataaattatatagtcatcctatcttcaccatgcagatgacagaagagaatatgagattgtgtaaagatgcacaatgttgctgaaaagaagccacatatagtcactgttccataaaggcagtgtttttttaattttaaaattctgcatctgaaaacacagtatgacagaaagcatctatatacacctgcagtgtttttggtatgatacagtatttaatacatccactgttttctgcaaaaaatgttgctttgtcagacagaaacaaactcccctagacaaaaaaatacagctaaggcacaattttgttgttgttgttgttctgcaaaataaaaagacagaaaaggtgcaaaaaagggcaggtaatgcagtcatttctgagactcacattctacctcaaggaaaagcattcagatgattggaactttgattactggtcaatttcagatagttcaatatctcttaaaatactcctttaaataaatagcaaaatatctacatatttcagcgtgtgccatttgaattctttttttaaaactttatttacagattttttttaaaatcaacacattacaaaatatttctgtacagttttatgcatattatgatctataacaaaatagttatttttaaaaactatatcaccacatgtctttgaaaacaatgaaggggacggtaataacttagagtgaggcctctaaaacaaatacccaaacaaatgctattgacaacataatatttaaaaaaaaaaaaggcaaaaggactacaaagacaattgcgcacaattccagtgaatttcctatgaaaaccctggggttgtctttggcctccatcagcactggagcaatggaagggtaaagaatagagtctgaaggtagggaaagggtgattcctttgagaacactacccatctgctgggaatatttagtgctatcactttccaggcaggaaggacgaagagataaatggagaacgtctcctgatttacccttgaatgaagtacatataaagtcacccagtcttgggggcaggggaggtctgcaaagccttttcaagcactctgccgataattaagccagcccattacagcagcagtatgctctgagagagtgcttcaggagttggctgagctttagatgagcacccaagccttcattttgcccataggaaaaatataagaacatttttcttaaagacgacatttgtaagcaattcctatagcatctgccaactacagattggcagccccttccttaggaggctgccacagaagcttcacgatgctgtcttctctgatgttggtggagatgggagggaaaggatggatggtcagcttcccaaaaataatgttaaggccacatttcaaaaaggagaaacctaaggcttttgttttgttttgttttgtttttgaaggagggatgggagaagcaagttggaggaacatgagggatggagtagatgacgttagggagggggatgacaaggtgcagaacccgctttctggtggtatctgtaggcagaggcagttggaatattcccagccaagtggagagggaagagaggtcactttctccctgcatacgcctggtaagaccagagccaaagacaacgtgaggggtagacacaggtggcgcaagaaagccctcctccatcttaagagggtcctatacagtatcttgtttgcaaggtaaacacaaaacaaaacaaaacaaaacaaaaaaacttctaagagagccagagaggaagagagagaggagagagagaatttgcatagatcatacattcagctcaagcagatttggacaactttgttcccccctcccaggtaaacttctcagcagacacaatgaggtagcgcctgtggtagacccatgggcaaagtaaggtaactgaggcagaagcaaacaggacatcccgtgagccagcacagctctatgtggtttccaaagaggcttccagggatgggacaagatggctgtgtcaacacttgggatttggagagagcctggctgtttcacaccctacctcctcctcctcctagactgtctttgccatttcggcctggtttgatggagtcccacaagctgtagccccaggcagatgtggacctctgcatatctaaggggcagcagtccagatctccagattctattccttcttcccttcagcacaatcttgggaccaggagagctgaatgatccatcccccctctgtggaatggtctcttgaggagtggaatgacttagcaagaggtccccattccgagttcaacatgggctgttatttttgccctgacctgatgctggcttttttcctcttctaccagggcaatgcataatctcactttaaaccacctctccagagagcagaggttgctggcagtgtacacgtggaacagtggaatttttctttgcccactatctgttaaaaaaaacaaaaacaaacaaacaaacaacccgacgttgaaaaatcagattttttccattaaatctggatttccggcttcccttccaaattggaagattccactacactgtgcttacatttttacaaacaatgacaggttggggctgagtagcagctgctcattctgggtaggtcacgtgcatgccagtaagaccacagtccccatccttgcccccaccatgcccttttgcctcacaccaaccatttcacgcatctatgctagtattctgggccccataaacatttgtaacccctaccacagtgtgtggctttgatcctgcaggtctagcttgctgtctttaaagtggagtgtgttaacagctgtttctagaatgtacacctctccacccctagatgtacccctccacctgaatgtacacctctccacccctcgatactgctgggaagctggtgctccaaatcctcagtgaacttggttgtgaaaggactctttattcacaccccactgccagtagctactgccctgctctctgcatctttttggcagaaagcttaaggttctagccagtgtcttctgtgttatctgcaaactagagaaccagagggaaacatggtcttcagacaccctacttgtgcccagagtagaagcaattgcagtgagtgagagatgggggcaggtcctgtggttctgctcatcctctctaaactccatttgcgttttagaagttaaacccacaatgagaaatgaagccggaaggactcatgatctcaccaggaaagccttttttttcccctgcaaagggagaaagcagcgcgcttctcacaacacggggaccttgggaattgctcactgcctccttggagacacactgctttacgtgtggaccgggaagtgaagtgggatgtgggaaggctggctgtctcctgagctcaatttctgcctgaatgtcactcggtgggtgggaaactataaggagtgccgcagcctaaagaatgcttccttctccacaaaccaataccccaaggcccacctgtcagccttcctgagtttccagggacctcgtcactggctcagctcacagctgcaggctgtaataggtttccagagaccacagccctatgcttttgaaatcttccacagcccaagctccaggctgtctgaccaatggcctccaacaaataaataaatcattctcaggcaggttaaaaaaattattttccctgggaaaacatcctcttttctcaaatcatgctgggctttgtttgggattttccttaaaaaaaaaaacaaaacacaaaaacacaacaaatgtaatatctgcaaccttattctctggtctattaattaataacatcagagaagggagaggaataccctgtgtgacttctcagctccccgaattagttgtggtgaggaagaaatgaagccatgggaaaaagggaagggtccccagagtcagccagctctgccatttctccacttgttccaggataaaaacaaaaaaaggcagacatgttagtgggtgcaggaggggccccatcttgaagtctgcaggttcacattatgcacagggacttgccactgctgagtccccaaagccactgcaaataacgctgcgaacacaaagcactggtggcccagcaaggagggtgaaagggaagctcccaaagtggcttcggcagccccagggaaaccctggccagaggcagaggccgggggcagaaagaggatgtggcacccagcgcgtggccaccatagagtctgtaaaagagatcataggggctttctgagaaaagtaccctgagatccctggaatcgctgttgagaatggctatctcccggactctgctgcctggatctgacgaccctcctcctaagatggatctctctcaaaggagcctgtttccctctgttaaggtcgcatgaatgcccataattagatgggccatgggaaggcaaccacggagcaagcaggaatggcccaaactctctgcagctagcacattccccacaaactctctgcagctagcacattccccactcaccctccacgttttctgcctgtcacctccttgtgcctgtgacggggggtgagtagggggaggatgggaggctcaggaattccaatactcttggaatccgagggagagtgaggctgacactctgcataaggaaaaaaacaaggctccaacggtccccaaggcaccccactcaaagccagtggaagatgcgggttggagctttctttgcgtggtgttcgatgcccctgctttactctgaggatgaggaggatggggggtagacgcagagaaagagaaaccgagagagagagagacaccagggggtgggaaaagatgggaaaaggggccttttgtgaataaaggcagcttcagttagtaaggtaacataattgacaagctgcaaaaacagcacctactaattagtcatcgactaaaacatgtaaataataaatatctaaagtgtcccttctctacgtcctccattgccaacaggacaccctgccttgcgaggcttgggatggggcaacacatctggctaggattaggacaagtcacacaaagcgaagggcagccccttcaaacccacgctggagagaagtgtcaggactggctctccatgggaagggcagatggctaccaggggtgagacctttttccaagggaatcccatcattcaggggaggtgggattacaggagcaagggaggcctcctgcgaagagctctcctggtgaacagggatgacactccagggggctcgtggcaaggaaaccttttgggtttctggtaactcaacacttaaatcatactgttttttgttgtttaaataaccttcccatttttatgttgcatgtcccgttgagcctgtggccgaagggcatgaaattaaaaaccaaatctgaaatgctatttcctggacgggaaaagtctggttcatgtggtttggtcactcccaacagcaccggtgtgcaattgacgaaggttttgtgtgtctgacctcagaacggaagggctctggcaggggatgggtgctgctgtgctgtctagctcaggagttttgctccaagcattgctttgtgagtttcatcgcgttgccttgtgagtttcatggtcatggctgtcaaagttcccattttcaaggatcaaagaaggtcatggtcttgagtctggtgctcacaaacatcatcctatttctgctactttgtgtggcagccttgagggaaggaggcccagacccctggacaggtggcagttgcacttgtggctggaccttggccatgccacatcaaaaggctttcccacttacctagttactaaggagaatagttcaacccaaggagggctgctgagaggctcagagctctcctaaggctgcagcctccatgggaaagggcccacgaccatgactttcaaggctggcaccagagtcccccagccaagagaagcagaaaaatgaaccaaagggcagggctggagtttgaacccatggttggtctgggcagtgcttgtcaaactggcatttgcagagcccttgggttctgaagaggtaccgtaggagataccctgggcaaggggaccgcccagagggctgagctttgggagggaacctcgcacttgtcagcttcaaccagagcagcttggatttcgtcagcaccctgaacctccacttatgactgtgctccgtaaacgaagttctgctgctcgaaagaaaagtctgaaaatcacacgtctggggtcaggggtgggtcactggaaggggaagacaaggaacctgtaggacttgaggatcaaccagaagaggtgagacagtcacagtgcagggactgagccatcccacccgcagcttgccaaaggcaggttgttggctgatcctgctttgacctgctgaccttccctttccatcattctatggccaggagagacccattcacagagggcctcccccagggtgggaggccggggttcaggccccacaacccctctggctgctttcccgttgagatcctgctgtggcccactcctcgtgcccagtgctacctgagccggccatcaggtttgactgcccccagctccgacttggggtcagggctgaaggagctccaggccgtctggctgcaggtctgcatgaccgggcaggctgtggggcccgtggcacagatgtccatggcagtccacatcccgcccaccaacgagtccagccatccctccagcgctgtgcccgtggaggctgcgttcctccgtgcctgttccacctgggcggggttgatgggcaggctgaggacggggtttaggctctggaagctctgctccatgtaggcattgcggaggggcccattgtgcagcttcagtgcctcctctgaaagccaaagggaacaatttcaggatcagaagagccaccaataggatgcctattcatacttaccctgtgcctggtgctgcactgggtgccatgcatcgcctcatttaattcacatgacaatctcatgaggaagttcttttagcagtcccatttcacagctgagaaaactgagcccgtaaggacagagcccactttgtacagggcacggtgcatgcctttattcattcaacacatgtttatagcgcatctttgatagtgcagacactgattcagccaatatatatttttaagcacctacattgtgccaggcattcagtcaacacatatttactaaacacccatgatctgcaaggcactgtctcatttgataaagacatattaagtacctattaggtaccaggatctattctaggtggtggagcaaaccagataggaaggttaagatccagtggagggagaacaacaacaaagaaataagtagataaataaggttatttcaggcagtgataagtgtcatgaaggcaaaaaaacagggtattgagacaagagggttggcaaactgcagtccttgggccaaatgtggcccaccacttgtgtttgtaaataaagttttattggaacatggctgtgcccatttatttgcatattgtctgtggctgcttttgtgctaccagagctgagtatttgagacagactgtattttacccaacaagctgaaaatatatctagccctttacagaaaaattttgctgactcctgggttggagagtgacagtgacctgtacccaggtctgtttgggaagtccagatctcagctgccgagcgtccaccttgtactctgcgtaagttggatttctgcttcctagaagcctaagggtgcatgaactgaccacagaacaatcactctgaaagcatgaagcttggacccgggtgaggtggggtgggaggtcaaactagctctcataacagtgctgccttgctgggcccctcctatgtgccagtcactttgtgaagcacttcatacaagagcccaggtactgcagtcatgctgtctggttttgcagccccacgtccaacataccaggtgtgtgacttctgacctccatgccttgtacctcagtttcttcatcaataaaatgggtaaagtactaatgccttccttctcactttgtgaggcttaagtgtgctgactcatataaagtatttacaaatgacacctggcatatactaagtgctgggaaaagcttagctagtgatatggtttggccgtgtccccacccaaatctcaccttgaattgtagctcccagaatccccacgtgttgtgggagggacctggtgggaagtaattgaatcatgatgagtttttgccatgttgttcttgtgatagtgaataagtaagtctcatgagatctgatggttttttaaaggggagtgtccttgcacaggcgctctggcctgccaccgtgtaagatgtgcctttgcttctcctttgccttccatcatgatggtgaggcctccctgaccattgaaactgtgagtccattaaacttcttacttttataaattacccagcctcaggtcattattagcagcatgagaacagacaaatacagctaggattattactgttggtattagtccataatcctcacacacctaaaaaactagggggctggttttatcattcctactttacagatggggaaagagaggcagctggagttagagacagatctggggttaaatccaggaccgactgactccaaaggcagtgcttatcactcaccctgatactctactgctcaaggccatcaccaaggtctgatttttcactcatgcaaaaattcaaacaattgggccaggcacgatggcttacacctgtaatcctagcgctttgtgaggctgaggcaggtggatcacctgaggtcaggagttcgagaccagcctggccaacatggtgaaaccccgtctctactaaaaatacaaaaataagccgggcgtgatggctgatgcctgtaatcccaggtactcgggagggtgaggcaggagaatcgtttgaacctgggaggcggaggtttcattgagccgagatcacaccattgcactccagcctggtcgatagagtgagacttcatctcaaaaaaaaattttaaaaattgcaacctcaggcataaatgggttaaacagtaacatgtacgtaagagtgactactactactacctcccagggctgcacgatgaggaatcaggaagtatagcaatttggggtgaaggaaagaagctaaacacttctattatttctaatagatgctatttctaatattttgaagacgttcacattcattgcttgttttattgctcagtagaagcacatatatatttttaaaaaggctggccaatgagtctggtgagttgcgctttaccaaatcaggctttgcgagagctgagatagctaggattacaagaaaccttccaagataatgcagtgttcagaagacagtgcttcctgtttgcctgacagcagctgccaccaccaaaggcacccaggacagcctggatattaacaagtgtccagagcaggcaagaagaaggaagaaagaccatatgctaacccttctaaaagcagtgagaatagtagatgaattcaaaatttgccttgactaacacagacaagatcgccactccttcaattcccaatgccccaggaagcaaaagggttgggttctgtggtttggatgggcacaagtgggaggaaggaggtgagcagtcattgagcacatactctgtctcgcaaggggtttagcaaagctgctttctcccacggtagttaggagccacagtgtttggaagtctggtcctaacccatctttctctaatacagggtagggtgggcagcttcagccccacctgccaggagaacagagcctgctgtctttggtgcgggccctaatttctctatcagagccccttagtgcctctattctgcagagtgagaaagtggagaatgaggagataccgaaactgacaaaaggcaggacattcaaagggaaaagagcagctaacaaacctgcgaacgctgggagccaaatattgtggttgatgcaaaaaaacccttatgagaaatgaggttaatgtgggaaacgctattacaatattagcttgcgatgctcgtctctataattaaattttcctcaattccacctcatcggatttcttgcgattaccagggacgcatcaatagaaaattactcttgatgaatcattttacaaattgcattgctcccacctttgtgttcactgtcattcattggaacatcgctaacaaatacaattaccaaggacaggagggctgctctcggtgggggtaaaatgactcctgggtcatcctgggcatgtgtagggagagccctgccttccttagaaaccctagaagaaaacactggaaaaatcaggaccccatgaatggcccccaggctactccactggcgtgggggtgtgttcaggagcactgcttcattctgaccaacaggtgtacctgaagcagcgaagacacagccatttactcccctctcctccatgtctggcattagacatcgttagagatggtaaagatgtgaactagatcaagaaggaacctaagacctctaagggggtgggattgggcctggtcagctctggaggggctgtcttttgcctggttcatggggaagaaggagcaggcttccagctcaagaaaacatgaggtctctgtctttctgcttgctctgcacaaagacagcagaagctgagcgtttacttcgagactcctatgatagaggattgattgattctttttttgagacggagtctcgctcttgttgccaggctggagtgcaatggcatgatctcagctcactgcaacctccacctcctgggttcaagcaattctcctgcctcagcctcccgagtagctgggatcacaggcacacgtcaccacacccggctaattttgtatttttagtagagacggggtttctccacgttggtcaggctggtcttgaactcccgagctcaggtgatccgcccacctcagcctcccaaagtgctgggattacaggcgtgagccaccgtgtctggcctatttatttattgttttggagatgatagagtctcgctctgtcacccaggctggagtgcagtggtgtgatcttggctcactgcaacctccacctcccaggttcaagcgattctcatgcctcagcctcctgagtagctgggatttcaggcacccgtcaccatgcctggctaattttttgtacttttaggagagacagggtttcaccacattggccaggctggtcttgaactcctgaccttgagtaatccgtccacctcagcctcccaaagtgctgggatttcaggcgtgagccactgcaccaggccatgatagtggtttttgtccacggttcttggctcagaactcctgtaacccttcttacagtcttttcttacaatgttgggcactttaggactcagcaaatagaatctctctctcgctctggcctcctcctgtcccccttctcctgcctaatgccagagtctaatcagattgtgggtgataggactctcattccagagagggccctgacacactccctggaggaaggaattactgcacagagaggccaaggagaatctgaacagacagggcttgctgagttaggtcagaccctttttgtccaatcacattttgacacagttgtcatgcttcagtcatgggtaaccaatgaagtcttcataaaaggcccaaaggacagggttcaaggagcttctggagagctgaatacatggtagcatcttcacaggaaggtgaggaagaactcatccacctgccgggacggtgggcaccccaatgccatggggacagactcatccacctgccaggagggtggtgcaccccaatgccatggggacagattcatccacctgctaggagggtgggcatccctatgccatggggacagactcatccacctgccgggagggtggtgcaccccaatgccatggggacagattcatccacctgttgggagggtgggcaccccaatgccatggggacagaagctcctgcactcaggactcctctggaccttgccctctgtatagcttcatttggctgtttatctgcatcctttaaaatatctttcataacaaaccaatagacataagtgtttccctgagttctgtgagctgctctagcagagtaattgagcccaaagagggggttgtgggaaccccagtttgaaaccatttggtcagaagttccaaaggcccagacttgtgattagcgggcagaagggggtggtcttatggcactgagccctcactctgtggtgtctgatgctacctctggggtggagagtgttggaactgaattgggggacacccagctggtgtctgctgcagaactgattgcttgcttgctgacggggaaaatttccccatgtattttgctgtcacagaaatcttctgtgttgatcatggcagtgtgagagcagaggaaaagtggtttgagagtttttcccaaacaactccctttgctaggactcaaggcacctcctccccatgctgtgtccccatccccttgcatcattggctaaaaggcacccaatccagaactcttcaaagctaagaggctgtaatgcatttctggcttttgagtttgtgatctgttagagatggacatgaataattccaaatatagagagacccagaaatcctgtttctacgagtttgtgttatggatgtaactgcatgggaacatacaatttttttttcttttttgtttttgttgttgttttttgagacagagtctcgctttgtcacccaggctggagtgcagtggcgtgatctcagttcactgcaagctccgcttcccgggttcacgccattctcctgcctcagcctcccgagtagctgggactacaggcacccaccaccatgcccagctaattttttgtatttttagtagagacagggtttcactgtgttagccaggatggtctcgatctcctgacatcgtgatccacccgcctcggcctcccagtgtgctgggattacaggtgtgaccaccgcacccggctgggcacatacaattttatgtttaagactcttccttgttggggctgggtgtggtgggtggctcacgcctgtaatcccagctctttgggtggccaaggtgggagggttggtttagatccaggagtttgagaccagccaggacaacacagaccacacaaccacaaaaatagttaaaaaaaaaaaaaaaaaaaaaaaaagccgggcatggtggcacactcgtgtagtttcagctacttaggaggctgaggtgagagaattacttgagcccaggagctcgaggctgcagtgagctatgattgcatgactgcactccagcctaggcaaaagagcctgacctaaattcttttttttttttttgagacagaacctcgctctgtcacccaactggagtgcagtggcatgatttcggttcactgcaacctccgcctcacaggttcaaacgattctcgtgcctcagcctcccaagtagctgggactatagacgccggccaccacactcggctaatttttgtatttttagtagatggggtttcaccatgttggccaggctggtcaggctggtctcgaactcctggtgtcaagtgatccgcctgccttggcctcccaaagtgctgggattacacgtgtaaaccatggcacccagccaacctctgttatattaaaaaaaaaaaaaaaaaaaaaaaaagacttttccttgcactattatcagtaacatcatcatcatcagcagcaacaacagaaacttatgtgtccaccaataggggaacagatagattgtggttccttaacccagtggaatatcatgtagctggtagctttatatatactgacttagaaagtaaaaaaaaaaaaaaaaaagcaatcttacagtacacaatgtattatttcatttttaaaaaatagcaaaggttttgtgatttatggtgtgtattatgtttatgctttacaagtatggaaaaacttctaaaaggattcacaccagactgttggcagtggtttctctagaggtaggatttgagcagggagaaagactttccccttaataaaaggaggtgaaaaggggcgggggaaatagaagtataaaagtaaaccctttcaatggacaaagaaaaaagtcaggcaggataggaactgacatcccagtccctgttctccatggggatggaaaccctgacctgaatttcatgttaatttcatgtttcatttcctaacagctgcctttgacatacgactcctgaaataagatattgttgactttgcctgtttttgaacttgacataaatacatcataattatgatttatctgtgatatttccccctcaacactatgttttagggactcatccaagccaacacatgcccatgctttactgctattcacggctgcatagtactccattgtatgaacagccagccaattgtttctcctttccagtgtcaggcaatcagaccgtttctggttttgtgctattaagaataattctcatgtgagcatttctgcacatgtctctagggcctataccttggggtcagacgtctgtggtagggtgtgtgtatgttcagctttactaggagatactaaaacattttctaaactcgtcttagcacttcaccctcccactagcactgcatgaatgcctattgctctcagccttagtaacacaggttcttatctgtcacgcatttcccaatatgatgggtgtgaagtggaacctctctttgctttcaattttcatttctcccatttttaatgaggctgaacatgtttttgcgtgtgtgaggggccattcatgttctctcctccatttttttcctctcttttatagcagggttggtggtctttttttttgtaaagagccagatagtatctttggctttgtgggccatgcagtctctgtcacaactattcagttctgccactgtagctctaaagcagaagcaggcaacatgtacatgaatgagcatggtgactgtgttccaataaaactttatttacaaaaacaggtagtgggctggattggccaacttctgatgaatagcatttctttataaattctgaacatgagtactttaaaaaaatgtagcaaatatcttctactattatgtggttcatcttttccacctagtgtatcatatttttgatgaacagaatttcctgttttgatttttttaaaatagtaaacaagatttgctgatccttaatacctgcctgggtttatttcccatcttgtcttcaatatgatctaggctttctggaagttgaatgggggagcgtctaacaaatagctacctaatacctagacagatgacatcatctccgtgtgcaggtaggacattagatggtttctctagggaaacacagagaaaagtattgagagcaaggagtgctgttctgtgaggccgctgcttaccctatgtctgagcagtgctgcctaccaacaccaaagaccctcaaggtccccagggaaggagtatttctcccacatagacactgggagtacttaccaggtttgatgggctgcctgttcgagaaggtcagaggcgcaacgaggaatttggtctctgcaactggcacccagtggtggagaattttcactgtccagaccccaggcctcaggggcaagttcaaagggggcttgtagtgtgtgaattcggcagtggactcaatgaggatgtcgtaggtggctgcgatgacattgacgggatccacccaaatgacggtcacggtcacattaggtcccttcccccacttctgcatacccaccggctcatccatgggccccagaagacccccaaagttgcggaatagcctctccttggcatcccagtcagtgccgacctgaaacaggggagtgaattctgaagtcactgggcctgaactagggggctaggtctcagaaaggtctaggatcccctttgttagctttcatatacccattttacagatgaagaaactgaggctccaactaagtcacctgctcaaggttgcacagcttgtaagcagaagatctggcatctggactcagtctgaaggatcaaaaggcctgtggtccttttattaaaccaccgggcctcctgtgcctggtgtatggcatgtgctttgaaaagaaaaccacacatgagctgaatgagtgaatgaatgaacgaatgaatgaatgaatgaatgcatgtcttgcttgcaggccattccacagaaacatacaccctgccactcaacaggtacagcgggtttccaattccatccttggttttctaaatcacacacctccacttggtgcaatggttctgaacaagaatagagatcatgtttttacagctgctctatcataagctagagaccctcagcattgcctgtcatctacaggggttcaaataggtttcctaggaagagacagctttggctttcccaaggcacctagatctggactgtaagcatgagagtcatcctgcgatccttccttcctgccagccagctgggggtgtgtgcagctgtgacccacagcaatcctctctggtgggcttccctccttccacttgtgccacctgcaatttcttctatatcctgtagtcagaaaggccttgtaaaatgtcctcttactgctgcccccaggcttcttagtgcactcagagtctgagctcaccccatcctccatctccatgaccccctccccatctttctccaggatgccttgttttagccacctcaatcaaggcaggctcattcccagctcagctttcctgcaccatctgccctgtgtggaatactcctttcttgcacagccagccccttatgtctaaagctgcctcacagagtctttatctgaccaccccccaccccaaatttcaaatggaccttcagtcaatctgtgtcattccctactgctttattttcttcctatcagtggtgataagcactatctcagagttgtatgttgatgtatttattctttatctcctccagctgtaatataagctctgtgtgaacaggggttttacctggctggttccctgctctttcttggtgcctactaccatgcttagtacacagcaggtgctcgagtaatgtttgttgaatgaatgggtgaatggcttgaccaaaaactgaatgaactagggagattcctgacaaggacctttgttgctatttcaaatcaaattaaattaggggtcatctaatttgaaaaaaagatctcccccaggtggattaacttagtggttttgaggacacagcatgtgggcatgttggggcaaataacgggtacagtatgaagcttgcactgcctctgctgtcttcccataattagcatctctaatgtgtgtgtgcacgaaggtcgggtgtggatacacatacccacattctgagatttcctatgtgcaggggaaataggagctgatctagcttctcattgttcttgcaagaggtactatgtcagtccattctttacccagcttacagagcttcactgctaatatttgctgagggattacagtgtgccaggcagacgtgtccattcagttgatactcccaaatccataaaggggagacccttgtcattatctttactttacagatgtggaaactgagtctcagagaagtgagataactcgctatggtcagagggggcagagccagcatgggaacccataaagtccagccccagaggctgcattctcatccactgtgctacatattgccttccattcatgaattcattcactctctcagtcattcattcacccaacacacataaaccaaatccctactgcctaccaggggtggctgccatctgtgtacactcactggcatgtgtcttgctttcagttttcatcaggccagagactaaagattaggactaagaaagcatcctgagagtaacagaggtagttactgctctgatgttcctgtgggggctgccatccctcccagacttatgaaatcttggtatttttctactaccctgtggatcagcagggaccagcaccttctgggaccctccagtgcctagcatagtgcccggaacacagtaggaattaaaaggatactatttattgaaggaataaatgaatgatcaacaggattcagttcaagcttcaaggtcttagaggtttttctaaagaaacccgatttctattttcctgcttacaacccctttcagcaactcttggtttctaagtccagttgctttacctgtcctggagacctttctggtctggctccggcttcacttctgtcatctctatccctctccctcccttccacttgctccttgctccaggccaccctgggttattcccagcacctcatccggaagggctctgtgtttcctcttgatcttctggccatgatccgcctgttctctggaccggtctacctttccccgcatcctccaggccacctcaaacttgtaatctagattttggctcaggcatcacctctactcataagtctttcctggatagaggcaccactgaggtacatatctaagcatttgatcatcatagcttttctcctgacccccacagtactgcatcttttaatttacaggtctctctctctccagatctagaccgtcaactccaagagggcagggactatatatggcatgctcaccaatatgtctctagtgtctgaaacagtgctgaacatagagtaggtgctcaatatatctctatagagatctaaaaataaagatatattgagcacctattgtctattgatcgatcaatgatctatacagattgatcatctacttatgtgtgtttatcatctatctctaccaatctgtcacattaatctgtcaactctattgtaaccattaatcatctatccatctgtttgcctattaacgtatccacccatctgtctgtctgttaatcaatctatgtatcacctgtctatcaatctatcttgaacacatattgaatgagtaggggctgaacacatggacttccctccatgcactagtttccaacagatactaacaaaacagatgaatggccacaaaactactttagggtcatatttaaggaggtgatttttcaccagttaggggaagatgggaaccctccagaacactgcccttggatcctccaaagaaatgaggataaacacttccctgaaatcgagttttaaaaccaagataacctgggcaggagagttctggagcagctgacaaacaacctggatcttgtttttcaaccgaggagcgtgaagggtgaggtgtggggcagcctgagctagggccctgctgctgtcacatcctccaagaccttctcaaggggcctcattgtggaagtccaccaccatccactgcagaatggtcaattacccaaattcaaatacatattcaaattcaagcttaacatactgctccctggcttccaaccaaccaatggctttccattgcgtttatttatttattttttgagtttataatgtgtatgtatatgtatatatttcaataggtttttggggaacaggtggtgtttgcttacatgaataagttctttagtggtgacttctgagattttggtgcacccatcacttgaacagtatacactgcaccccatgtgtagtcttttatcccctatatcccctcccctatatcccccaacccttgcccatgagtccccaaactcactgtatcattcttaagccttgatttcctcatagcttagctccctcttatgagtgagaacatacaacgtttgcttttccattcctgaattacttcatttagaataatggtctccaattccatccaggttgctgcaaataccattgtttcgttcctttttatggctgagtagtattccatggggtatatatatatatatgcgcacacacacacacacacaatttattcactgattgatgggctgcttccattttttttgcaattgtgaattgtgctgctataaacatgcgtgtgcaagaatcttttttgtataatgacttacttttctctggtagatagcccacagtggaattgctggatcaaatggtagaactacttgtagttctttaaggaatctccacattgttttccatagtggttgtcctagtttacagtcccaccaacagcataaaagcgttcccttttcaccacatccatgccaacatctgttattttttggttatggccattcttgcaggagtaaggtggtattgcattgtggttttgatttgcattttcctgatcgttagtgatgttgagcattttttcatatgttcgttggccatttgtatatcttcttttgagaacggtctattcatggccttagcccactttttgatgggattgttttttcttgctgatttgagttccttgtagattctagatattagtcctttgttggatctacagattgcaaagattttctcccactctctgggttgtctgtttactctgctgattatttcttttgccttgcagaaacttttaaaattaagtcctatctacttatctttgtttttgttgcatttgcttttgggttcttggtcattaagtctttgcctaagccagtgtctagaagggtttttccaattttatcttctagaatttgtatggtttcatgtcttagatttaagtctttgatccatcctcagttgattattgtataaggtgagagatgaggattcggttccattcttctacacgtggcttgccaattatttctgcaccatttgttgaatagggtgttcttttcccactttgtttttgtgtgccgtgttgaagatcagtaagtatttggctttatttctgggttctctattctgttccactgttctatatgcctttttttataccagtaccatgctgttctggtgactatggccttatagtatgctttaaggttgggtaatgcaatgcctccagatttgttctttttgcttagtcttgttttggctatgcaggctcttttttagttccatatgaattttaggattgctttttctagttctgtgaagaatgatggtggtattctgatgggaattgcattgaatttgtagattgcttttggcagtatggtcatggtcacaatattgattctacccatccatgagcatgacatttgcttgtgtcatctatgacttcttgcagcagtgttttgcagttttccttgtagaggtctttcacctctccttggtgggtttgggtttgttcttgtttctctagctcattaaggtgtgaccttagattgtctatttgggctctttcagactttttgatgtgggcatttaatgctatgaactttgcacttagcactggctttgctgtatcccagaagtgttgaattcaggagcaagttatttagtttccatgtatttgcatgaatttgggggttccttttggagttaatttccaattttattccactgtggtctgagagagtatgtgctgtaattttgattttcttaaaattgttgagacttgttttgtggcctatcatatggtctatcttggagaatgttccatgtgctgatgaacagcatgtatattctgcagtcgttgggtaaaatgttctgtaagtacctgttaagtccatttgttgtagggtatagcataagtccattgtttctttattgactttctgtcttgatgaactgtgccaatattactgtgttgctgtccatctcatttcttaggtctagtagtattgttttgggagccccagtgttagtgcatgtatatttagattgtggtgttttcctgttggactagtccttttatcattatataatgtccctctttgtcttttttaattgctgttgctttaaagttttgttttgtctggtaagaattgctactcctgctcacttttggtgtccatttgcatggagtatcttttttcacctttttaccttaagttcatgtgagtcctcaggtgccaggcaagtctcttgaagacagcagacacttggttggtgaattcttatccgttctgtatcttttaagtgaagcttttaggccatttacattcaacattagtattgagatgtgaggtactattctattcatcatactatttgttgcctgaataccttggtttgtttcattgtgttgttttgcaggacctgtgagatttatgctttaaagagattctattttggtttattttgaggatttgtttcaagatttacagctccttttagcagttcttgtagtgctggcttggtagtggtgaattatcttagcatttttctgaaaaaactgtatctttcatttatgaagcttagtttcactggatacacgatgcgtggctggtaactgttttgtttaaggaggctaaagacaggacccttctggcttgtagtgtttctgctgtgagaaatctgctgttaatctgatgggttttcctttataggttacctgatgcttttgcctcttaaggttatttcctttgtcttgactttagataacttgatgactatgtgcctaggcatgatctttttgcaatgaatttcccaggtgttctttgaacttcttgtatttagatgtctagatctctagcaaggctggggaagttttcctcaattattccattattcaaacttttagatttctcttcttcctcaggaacgccaattattcttaagtttggttgtttaacatactcccaaacttcgtgaaggctttgttcattttttaaaaattcttttttgtgtttgttggagtgagttaatttgaaagccttgtcttcaagttctgaagttctttcttttactcgtttgattcgattgctgagactttccagtgcattttgcaattttgtaagtgtgtccttcattttcagaagttgtgattgtgttctatttaggctatatttcactggagatttttccattcgtatcctatatctttttttttaagttggacttcacctttctctggtgcctccttaattggcttaatagtcgaacttcttaattgtttttctggtaattcagagatttcttcttgatttgaatccattgctggtgagctagtgtgatcttttggggatgttaaagcaagccaattcacaattccttggctgtcccacagtgcctgcaggggcaatccacctccttcaaaggctctatggattctcttggctttcctggcatgtttctgcagtagttcttggagcaaaagttcatgatgtggggctccatacactgctctgtccatccgagtggaagctgcaagtttgtcttgcctcctatccgccattttccctctatctttccattgcatttaaaatgcaacctgaacatctttcccgggcctgcaagactactccctgaggcctctttcctaccagtttccttctcacttgctgcacccagtacattggtctccctgcaactcgagtactcctagctcattcccagtgcctaagggcctttgtatatgctcttctctctgcttggaatgctccagatctcccgaggactggctcttttacaggctttagctttgcagtgatctccttagaaaagccttcctagatgaatcaatcattctattgaaggttgtccccatcaatgtcctgagtccccagcaatcacatgaatgaagttttctctagaatacctgtcattagctgagctgtttgtttttgtttatctatttgctcactcactggctggctgtctcattggaatgcaattccatgaccacaggggcctggtttgtttggttcaccacaatccctcctgaacctggcacactgtaggcacttggtgactacctgcagaaagaatgagcatcttttatttccaagtcaacagcatgagattcccatgtattggagaaatgtatctgagctgttcagccacctgctgtgagccaggcactgtacaaggccctgggatagtgctaacaccaaggagatcctaaatagcccacagagtggtcctgtagttcttccttgcctttctgttcatttgctactaaaattaagagtttagaaaaaattcaaaatacaagttagggctctctgcatcacatgctgttatttttgccagtgattttgatggttctcactccaagggtaccagacctgtgtagtgaggaccatcccccaaaagcactagccatggagcggccaacatcatttgtcactgccagaagtacccagtcacccaacagcaggctgataaacagggagagcccagacaccaggcattcatctctttaatgggacattaatgttgtcaattggctgctcaggcccctagcacagaatcgaactggggcagtatctaattgccccctgatgccagtaatttatggaatgggctcccttggctgctcacatccagcaaatccactgggagtcttaattgaaaacagtggcttaacaagaaactctcactggtgcctgtttgtcatggggatacatacattcgttaggcagggccacagaagctagagaaggactgtcaaggaaaatataagagggtgggactccccctctccccaacatactcttagcccctcaagatgtaccatagtctacaatcagactcttggtccctaatccagcagtcagaaccattgtgacaaatcacgtccttagcacttagggatgtgaggaaggcagaaaccaggtgctgcagttttgtgtgaataacacgcaccaggcttgatcatgcttccccttccttcctgcaccacgacccaagtacactcattcattcattcaaaagtcttactcagcatctacaaagactacatactgtctgtgtgctggggataccacagtgaagagggagacacagttccagctctcttgtgaacaatcaatgagtgaccagataaagcaacaagataattttagatagtaaatgctaagaaaaagtattaaaatagggaagggttggatggagaatgtagctattgcagcagcttaagtgggtgccggggaaggtttctctgaaggtgtatcatttggatttagatcagaatgatcaaaaacaaagctagctatgtgacccatctgtccatccatccttccttcaatccatcattcatctactcatctaatcatatattcagtgattgatctggtacttcccttgagcgaatccaggtgtgctaaaaactgtggagacaaaaccacaactaagcataggatttgtggccaaagagacctaggttgaattttgagctctcccacttcctagcaatccagaaaatctttggatctctataagcctcagttctccattcggtaaaatgggactaatattactgacattggtttaggagtcatcactggaaaaattcagaggagcagaaattctaccctaaaaaatacaactgtgttccagttggtttgatcctcccctgtttaagatgctggtgccagtgactggggccggagaaccttcttcgggcacagggttagcttatctttagggatctccaagtcctcttctcctccatctccaactagaagtgtcagatagtggagtagaatctggccgagggaaatgcaaaatacaatgaaatgtgacaagacctggcctcttacctcggaaaactgaagcctcccaaagtcactgggtgggcttgcgatcttgaagacttttttcggcatcacccaggtctccagagtctctagtttgctcacagccagattggtagcatgatgcttgatcagaaagccctggaagcggtcagcaaggaagtagaggtgcacagatgctgggtggcccattgggtagtatctgaaaacacaggcgctcatgcattagggcccaaggtgtgtaggatcacagtgaggctccccacccaccaagctagttttgttcctaaagcagtccccattgtgcacaatgcctactgttttccttgcgtcctctgtatctatgatctcaatgactatgaatacttttttcttctgctgattatgaatgaaaaacatgctgactgtaggaaagtacaacaaagaaagtgaaatgactactttccatgcctcttcccatacataatgtccattcacagatattgagtcctctggtgcttggtaccgggcagtgaaaatggtgtgtgaacactcatattgatggatttcccttcggccttatttcctatgcatctatttgcataaatactatttgcataaatactacatagttggcatctatctatcctagctattattctgtcttcattgtatagtatttcctgaggattatcacatctttgaaaagtctctgaagacacgattttgtatgtgttgatgctcggtgtgtttcatcatagttaataccagatttgatagagcaagttctctagcattggatgataactctaattttttgcttctctaaacaatgctgcattcaacatctttgagcaaaacctttcattcgtctctctctctgtttaaatgtctgaggctcttcgtgtctgcagcttaactgtttcagaagtactgatttattctctcacagtccttaccacttacactggttatcatctttaaccatgattgccaatctgagataaacacacatgcacatacatgcaaaagtggtttgttgttttaaaatgcacgtctttgatccacaaaaacttgctggctgaaaagggcagggaagtgaagcagagatgtccggagaaaagggggaagcagatggcaaaaaaggagtacctcggaggagaccagtttggtatatttcctacttgtcagataaatagctgccgcttctgcaatgtgtaaattgcacagctttataaggcgcttgtgggtccttcataatagcatttcacaaatcattgtccctgctcagctaaacgcagccttccctctggtcctgatctggagttttaagtctttatgtccaattataacagttagggaagctgccttcctgtgttcacacatctcctgaaatcattgccttgttactgggatgccttccagggagcatagaaaaaaaaaaaaaaaaaaaaaaaaacttgaacagtcttcagatggtttgttgggcattcaccgttcatgcaaacctgttttaaatctggactttgggagtggaaagtccagcgactgtgctgtcattctaccactgcagcaacatctaggcagggctatcacataaaacctcctgcgatgacagaaatattttatttatttatttttgaggcagagtctcactctgttgcccaggctggagtgcagtggcatgatcttggctcactgcaacctccgcctcctgggttcaagcgattctcctgactcagcctcctgagtagctgggattacaggcatcagccaccatgcccggctaatttttgtatttttagtagagacggggtttcaccatgttggccaggctggtctcaaactcactcctgacctcaagtgatccgcccgcctcggcctcccaaagtgctgggattacaggtgtcagccactgcgccaggccaaaagctttttatttccataggattttggggaacaggtggtgtttggttgcatgagtaagttctttagtgatgatttgtgagactttgggaaagctgtctcccaacccactagcaaagtgtgactgttcagcccttgaaatatggccaatgtgactgaggaactgaattttaaattgtatttagttttagttaatttacactgaagtagccacttgtggctaccgtattggacagcaaagatagtcatgaaagagccagtggtcacctgcattaatgtcccaaatctcccatctcctttatcttatgctttcttccatgtgactttgcaagtttccttgtacccgggaggcagaacctatttttctacctctggaatcttctttggacaacagaaagtggtagaagggctgtcacgtcagttctgagccagggcctcaagatgccttgcacatttctgtttgctttcttgctcttttgaggtcaccatgagagcatgcctgggctagcttgctggagaaggagacatttgaaacagcagagctacgccagttgtcccagctgaagccatcctaggctcaggcaactattcccagccaaggaccacagagccacctcccgacttgcagttggctgcagataggggagcaaggcctgcccatactgggaaaactgtccagctgatctgcgaacttgagcattacatgaatgcatattgtttcaaaacactgatttgggagttgtttgtttcacagtgttatcgtgacaatagacaaagcactgccagtgtgtgttctgtgaggtgggtaaagcaggagaatttgctgttacgggagtcaaaggaagagagtgtttccagaaagcagcagtccaaaaaatttagaagtcaatctttgattacttgcctcccttcaccttctttatattttttgagatggagtctctgtcacccaggctagagtgcagtgtcgtgaaactggctcactgcaacctctgcctcccgggttcaagcagttctccctgactcagcctcccgagtagctgggattacaggtgtcagccatcacacctggccccttccatcctctattctccttacacactgccagaatcccggtcaaagccaccatccttttatacctgggcctctgcaggagcttccttaattgtcaccctctcttacttttgcccactataacctgttcccatagtagccacgtccatcgtccctcacttaaatgccacaagcactttgcttcatgctttcagtaaaatccaaactccttacctggtccacaaagccctaccgctttctctagcccccttttgtttcctgctaccctaatccaccacttccttcctcattgctgcctctgacttgtcactctcacatgactttatcttcattttttgcacagcatttacccttattgatcttatattctggtttacttgtgcttaggtactgtctgtctgcacactagaatgggagggctttgagttcacaggcctggtccgcctggatcaaggctgaattctccgtgcctaacacacaggctgacacacgatagctactcaatcagtacttattgaaggagtgaaaattctagaaggattttctcttgaacctcaagttacatctacagtccctgtaaccaaggagtgagcacaaaagccctctgatgcctcatcctgactgtatttggtatctaagtaatgaaaactgttaatgtctcaaaacagaaaaataatcaagatgccgcacaaccaatcatcatctacaggaatgcaaccgaagtattcgtttggcccaaagctgtttttctttcttatttaaatacgatgagcactaaaaaaaattaggagatttggttggcaactccatctgcattcccacggaatgtactggggttcagctccatggacctccaggttcccatggtcagcccaccctgcagggggcacactgagtgattctagtgcttcgtgcctgccccggagggcatttggggacctgcaataaaatgctgacatccttatttctggatggtagattatatgcaaactttactctgattctctcaacctgccatttcagaaacttctgcaatgcatatgtgttagtttataatgagaaaaaaaaatcaataaacattatttaatgaaaggttatattatagactggaaaggcacaatttgcctaaaatacccagataaaatgagactgttaaagttttcacttgctgtttccccacatgccccggggctaggaatccattctcttctgccttttgggataagggtcttttgtcctgatttattttcaggctcctattcataaatacattggctttgcccacagcaaggcaccacagttccattacaataaaaaacgaggtggataccagaggattcctggctcgaggcaacgtgacggctcacttcattccaaaatgaatactagggagcaaccttcaacaaccctagataaattgggggtgtcttttggaatttcctgtaagatcatttaccttatacattctaggaagcctgcaactgtaattattatggaacgacatttgccttccaagtggcaggcactgcactgtctactggggatacatgcagggattctgcttccagactagcagtgggggggagagagactccctggtgaccttgagccaagataccgcacatactgaaggtgaagtccctgaactactttcagcttgggagacggtgggtgtggggtgagctatcttaataagtgtcatagaggaggtggtccttggatggctttgttgacttgagaaggggtggctgtgcagtgggaggcagtgagcaaagaaaatacagggagagaacaaggaattgttaccatcacacacagcaggttcactgttggctgcatcataatggcaactggcaactaagataccagcaatgacctgaaccctgagcagttagtacatggcaactggcaactaagataccagcaatgacctgaaccctgagcagttagtacataaaatgctgttaaaatgggaataacaaggctgggcgcaatggctcatgcctgtaatctcagcacttagggaggctgaagcgggaggattgcctgaggtcaggagttcgagaccagcctggccaacctggtgaaatcctgtctctactaaaaatacaaaaattagctgggtgtgctggtacatgcctatagtctcagctactcaggaggctgaggcagaagaatcgcttgaacctgggaggtggaggttgcagagatcacatcactgcactccagcttgggcaacagagtaagactctgtctcaaaagagcactgtataactaactcatcaggtagtttttgatgattatctcctttacacttcacaacaccttatgatacaaaaatgatgagtattactcttctcatttcacagatgaggaaaccgaagctcagagagatgaatgacttgcccaaggtcaatagcttgtaagcagagtttaaactgcaggtcctgggttcctaacccacactagtctccctttaaactaaatcagaaactttacggagagagaagccgagggatgtgaggaggtgatgggacagtgtcacagccctgcggaaaccttgctggccagggatgagacaccaggtgggaaacctgcctgtgttttcagagagttagtgaacaatcttcttccccccagccccgtcagagactgacgctaaaaaaaaaagatgctatgttgttaaatgaacaagaaaaagaaggagagtgattagaggcacttctgggaatctatcctaaggaaataatcaaaagagagaatggaaaaaaagggctttctgagaaaagatattcatcagaacattatttacaagggtacattactgacaatggcaacagtgaagggccagattaagcaaactctggaacttctgctcaatggaatactagaggcattaaaaggaatcattatcattgcggaagctactgagcagcgtggagaaatgggggctaatagtataatgccaagggaagaaaacaggatacccaattcttgttgcaattatgtaaatatccaaaatgcatattgcttcagaacaaaagaaagggtacacaacgtgaaagtcttgactggcttagggaaagagatgagaggagaagggattatgttgaattattttcctacctccccctcatcttctagaacactctttcctgaagtgttggcagttagtggtagatgagacaattgtaaggggtggttgagaagtttcaacaatagttctgcctattaattttctttgtgatatttttaggtgtgatgacattatggtgaatgtttttaaaagagttatttttcagagatacattattaaaatattgatggctgaaatgataggatgtctgggattgacttcaaactgatccgggaggaggcggaaggtgggtgaagatgaaaatgaaacaagatcagccccgagttggaaactgccggggctgggtgacgggaacatggggttccactgttctatgttgtacatctttgacattttccatcaaaaaaagttttgtaccttccacttaagacaaatgctacatatgatatggtgacaaaaagcttccttctaaagtatatatatgtagcatgaagaatgagtaaaatcattgggtacataggatatctggtatctgagaaagtaaagcacagcttggattggaaatgccacgcacgctaggagggtggcgttagatgagttttgggcaaaggaagagagaaagcatagggtggcattgcattgcagatccctaaagaggaagaaggacccccactctgtaccctgagcctcccctcctgcttctcagctctcctctctgcatcccatatagggctcaccggcagctgttctccccatccgtgtgcagggacgtctcggcccgtcgaagacccaggcgggcaaaggagtggtacaaggtgagtgtcacgtcgctcaggctgtggatgccgtcaggctcatcgtagacattctcccagtaggagcgcaggcccggggtacctgcagggtagttcccgtacaggtaatagtccagctgcccaatgatttcctgattcaccacggcttcaaacttgcgggcaaagaaggtaggccgggctgtctgctgtactcatgggattaaaaatagaaaagccacatcagcgagtgctgggggttggggggaacctaagggcatatcctgtggttagaagcaaagctctgctggacccgaattagctccgatactttttgcacctctgtgttctcagtttcaacatctgtaaaatgggttataataagggtgtgagttaatctgtgcagaacatctaaagcaatgataggcacttagtaagcatcatttcttagtaagcatcatttagatgtctgttaaataaactaaataattttagatggtaatagctgggatggatctcagacatcatttaggtacaggtcacaggctagtaatctagggcaaataaatacagcctgcagatgtattttagctagccatatttaaaacatgaaagagttcacggaaattcttttggcttctctttaaacagcaatagatctggcaaccccaggcccacactccacatggtaacaactggttaaagctgaagggtggtggctgttcctttagacagcacctaggttcttctgctcactgcagtctccaccatgccctattgcctctttggtatttcagccaacttgcagactcacaagggatcggaatctctgggactttgaaaaattcagattccaggccaggcacacacctgtagtcccagctgctcaggaggctgagacaggagaatcacttgaacctaggaggtggaggttgcagtgagccgagactgccgctgcactccagcctgggtgacagaacaagactctgtctcagagaaaaaggacctactgagtcaatagctctggagtgtagctcaaaaaaaaaaaaaaaaaattcccaggtgattatgattcagtgtttcaggaccactgatagcaaccaaactctcaaggcaacaggcccagagatggtaagggacttagctgagaacacacagcaagtcactatcagagatgggacgaagagtcagggtccagggttaaagaaatactaagcacctgtaagctaccaggtgttatactttatattcagtaaaaggccagacagtaaatatttaaaatagctttgaaaccttcagcttcgcttttatagcataaaagcagccacagacagacaagagactaaataaataggtatggctgtgttccaactaaacttcatttatagaagcaggcagtgggctgactttggcccccagggctagagtttgctgaccccttgtgtagggctgcggagacaaataaaacacaggtctctcccttgaggagcttattattgtctagtgttattattgacctaaagttgggtccagcactgttttcatggtggtagattaatagcagcaacaactactgaccacacacaatacgcagggcaatggacttatgtcattacctctaattttccctgtaacttggcaaggcaggtattatgattcccattttacagatgagaaaactgagctcagagaggcaaagcgatatgtacagactcacaccattgtaagatttgaagcccaaatgcatgactccaaaatccaagccctttctactgtatcactccaggactgaggcaactgagtaaactgggaagccccctgatcgtaagtacccttggtgttattctaaacatctcattgccagtctgcttcaggaaacctctctgtggtggggagcacagcttagcactgtagagagttagaccacctgaattcaaatcctcatttggctaccgtctagctgtgcaggtcaagttactcaaactctctgggcctcagcatccttaaaatgggttactagcatagtgtctagcacatagtgtaggctgctctttgattattatcaccagccccttgttaccaggaacccatctaggggcagaacaaactcctttctctgcctgcgattccgaccatagctggatcttctaacaaacagggcacgttaccatattattctttctctccaagttcttcgcgcaagaactctgagttccttacaggcagcagtgtcttgactctagatcttgggggatattcttaatctctgcttgctgtgaacacatgaggcactccttgtcagaggctacaatgtccccaggatgccgggctaggatacaaatgcttgtgcctgggggagtgcagggctctgggaatcagcacgtggaggttttgtgctctaagtgatgaagattctctgcgattagggcagtgagggacgggtcctctccaaacatgggaattcattgaataggtcaaacaaacattcccctgcaaccctctttcggctcagcatatcctttctgcagggaagatgtgagtttaggcagccccctgtctgccagcttaaggtggctggagctgctgtgtgggaaccttaaggggaatacgaacgacagaaaacctgcagtgtactctgcattcatacaggcacaaaaaccaggaaggcagcagggactgctggaaaaaaaccccacttggaacacccctccatgccttcgtttccttacctgaacaataaaagtgatgtctgccccagtaaagccaatgcccacacagcccggcacagaggagatcaaacacaaacaaacagcatcccgctccacatcaagggcaccttggctgggttatgagcctggcattgtgtccctgccttcctgtgttagtggtttgggaagtagcataccgtctctacacggtggctctagtgacctcagagtgattcgcttaaccattcagtggcactcatatttgtgctctctgctgctaggtgtggggagggctggaggaagaagccaccatgctggcttggagggagcagagcaggaaggggtgcccatcttggggccaagcactctcagggctcatggtaagtggatgagcattccccaccctcctgctctgcccttccccagaactgtaaattgttaggctgcccagagacagctgtaaaggggataatgttctacctcttcttactccttcaagtacacagaacacagtgttttcccacagaacacagtggtttccaaacctggctgctcctcagaaaagtgcaattcattaaaaatacaaattcgtcgatatcactgatgagggtttctcaaccagaggtgctgctaagcatcctacccatgcatgggacagcatgtcccaacagagaatcatccagccacaatggcaagagttctgaggttgaaaagctcagccctagatatatacttaaaagcatattcctgggtacaaatgtaacaaatattttgggagattctgatgaaaagggaataaagagaagatgatatgagtatggcctttggaaagttttttttaacctttctgtgcctcacagttttcatatccctaaaatggaataataatgaaaggtcatttgttgtttttgggttaatgagtcaatgtggttagaacatccctgaagtaagtgctcaataaacactggctattgttgatactgttaactattattaattatcaacagccaggtttgggcaccatgtgataagatgacctgcaggtctggccttggatttctgcagaggtttgttgggaaggcatcacttaggaggctggcagaccatgagaaagtctcacctggaagcggtggaagtcctgcggcttgaagtcattgggggagcagccgcaccagtccacgatgtgcttgtactggcacttgcagcccagcttgcgattccagttggtgatgcgcaggttgttgtccaccatggtgtcgcagtgggggctgttctccaggaccgtatggaagaaggactgcaggggagagagggacccagcctgagacctctcccagcctcccacagatgaactggggtgggaaatggtgaacccttgctctgagttcatgtaagaactggttgtttaaaagaatgtggcatctcatcagaagctgggcggcttcctgtacagcttgcagaactgcaagccaaataaacctcttttctttataaattaccaagcctcagattttccttcatagcaatgcaaaaatgtataacacaactacctgactgtcaagggactcttatgttctctgcatgcatttgaggtcagctgcccatgtggtccaactcagagcgcaggcggatgctctgtccaacagacaaatcaaagggattcaagtctgactgactgactggtgtgctggaatttcacccctggggtagggagaccagattgatggttgcattagacccagggcttcctgcatcgccagacggcaacatagggaagggagtgggtggggctgcttgctgtccatggtactgaaccaggtgccatattttctccctaatcccaggattcttggccaactgctttaagggatctgagaaagaggccatgttggatctgaaaagaaaaactagaggagaaacaatcaatcactggagtacttgagagactgccagagagtgagagaaagatttctataatagacagtcccaggcaaatatatttcctccctgttctctctccctaagggaagctgttggggaatctgtgtctgcccgttacaagttaatgggcacagccttctgatttcttctaaaccagtcctcttgaagtggtctgggagaagggagggaaggcagagatgcaggaggtgggactgaacagagaccctggagtatatgtgcttgtgtgtgctggggccagggaggggcagagaaagcacacacacggagctttggtcaccagtatcgtggtgggcgtcttgattaaaaatagccaaactcccaaacaatctcttctaaatggatgggtgggtaaatgaggctccagccgccaccccctgctgaccttcctgtgacactaaatgacaagcccatgaacctggattttaagcttgaattgcctacaagcccagggaggcatacattctccaacaagcagtgggaagatgtacccaattactgattgccctgtgtcctttcataatgatacagaaattccctgcaatataatggatgaggaggttatcagaattgagagaagaggtgattgatttttgctgaaataggattaaaagctgattacttaacatgtgtgcagaatagtaaaacctggcccagtgatgacaagctcatcatccctctgggtgatgggggcagtcagccctccccggagcttggcactgccccagacacaggtgagagatgtgctgggagtgtggcctgcagaaacacacataacctatgtggtcccgggaaggaacaagggaccgttcatgagaaatgccatagactcaatagaaacggaaccagctctgcactgttctcaagctggattggaaatgagggtgcaatcaacctggaggtcaggaagatgaatctggaatccctcaacccagctctgaccggcaggcagctaagggaatgtcagtgacaatccttcagaactggatcccctccccacttctagatggggctaggactgttttagaatactctggattaatggagtatgacttatgaaaccaacacccttttcttcagggaataatagagcaatgttcaacatgagaaaaggcatgcttggtgtaaaaaggtggtcattacatgattggtcattgtgaaggatgcgtcaaaagttgatgtggcggccgggcatggtggctcatgcctgcaatcccagcactttgagaggctgaggcaggaggaccacttgaggccaggagttcaagaccagcctggccaacatggcaaaaccccatctctactaaaaatacaaaaattagctgggtgtggtggtgggcgcctataatcccagctactcaggaggctgaggcagcagaattgcttgaactctggaggtagaggttgcagtgagcagagactgtgccactgcagtccagcctggatgacagaggaagactgtctcaaaaaaaaaaaaaaaaaaaaaaaaaaaaaaaaagttgatgtgggtgtgtcctgaaagggtcagcatatacagttgtgcaggttacacactacataccttttaggggtgccatcagcattgtggatgtcagaagggttttttaaataacagttttctggaaaatagccataaggttcttgttctaacaaaatctgtgtatcatgtgatttttatgaccaatgaaagccaagtatcttgaggaagagctgccttttctattttgcacaaagacactgtgtggactgccggtggtagcaccgtgtgtctactccacgcagcctctgtgcagactggagggagaccaggcatcctgctaagacagcaaggatgtctgggtgtgtagaggacaatgtaggtggacccagaatctctttgccaaaaattcagcatctgctttgccacaaaggctagaacaagcccctatctttcttgggaaaattttcccagatactcacctcagcaggaagcagggtgtaggagtagaactgtttcatcttggtcaccagatcgtctgtggagaaggtcacatattctacaaacctccggttcagcaggaaccagtccgaaccgccatccacggcaatgccctctgggatccgccgatctcccaggcgccacatgtgagcgtcgcactccaggaagagccgatccaggccctgcttccgaatgaacctgggagggagaaagctgcccttagcccagaggtgtcctgaaagacagaactccagccagagtccaaataaaacaacacaatcatagcgatgatggcaattattgagtgcctgctgtgtgccaggtactgctccagggctctgcgtggagtttatcacttgatccccacaagtgaggcatgtcaccgtatttacccctatgacgcaggtactatttgacccccaactttcatatgagggcactgaggcttagagagcccaggggacttacccagcacagtcagatgacagtgatcatctgctacagctactccttctctagagaactttggcaacaacctccttatgccatagaggtcttggcagtttagtgaatgcagaccatggacccttgtctcagaatagtactcttcaatgcatacaacaaaatatacagggttatgaaacagcgaaaaataaaaatccaccaaagttctgatataaagtaatgcctgtgcttcttgactcacacattatatacaggattacaacatttttaaaatttttattttttgagacagggtcgtgttccgttgcctaggctggagagcactagtgtgatcctagctccccgcagcctcaaactcctgggctcctgtgaccctcctgcctccagctcctgagtagctaggactacaggcatgcatcaccatgtttggctgatttttaaaattatttttgtagagatgggatcttactatgttgcctagactggtcttgaacttctggcttcaggctcccaaagcactgggattacaggcatgcaccgccatgtctggctgctgcttaaatttttttgtagagacagggtctcacgatgttgcttaggctggcgtaaaactcctggcctcaagcaatcctcccaccttggcctctcaaagtgctgggattataggtgtgagctactgcatggggcctggattacaaaatacattttaaaacactgaatgtatggtactacgtgtgtttctttattaatacattaaataacaagatatcatggcaggtctattaaatcctgtaattttttttttttttttttttgagacagggtctcactcggtagctcaggctggagtgcagtggcatgatcttggctcacagtaacctccgcttcctgggttcaagtgattctcctgcctcagcctcctgagtagctgggattacaggcacacaccacctcacccagctaattttttttttttttgtatttttagtagagatggggtttcaccatgttggccaggctggccttgaactcctgacctcaggtgatccacccaccttggcctcacagagtgctggggttataggtgtaagccattgcgcctggcctaactcctgaaattttgaagtagtggtgagcataaatgatatttagaggtatctgcaccaactataatgtgacaggaaaatagatgattcctactggtgaccgagtcagttagttactgctaatactactgtgatttgttacctacctttagctagatttcagttagaattccattaaaaaagatatcattttcttctcatccaaaatcacgaacctcccctgaatttttcccatgaaccctagattaataactcctactgtagtaactatatacatataatcatcttgtttagaattttgcaaggcaggctgggcagagttggcatttcctattttgtagatgcagaaaccaaagctgttcaggtcccagagctggtgacgtgggcatgttgggagggtggacagagctagaaccaaggcttttgggccaaacgctcagtccattagcaattagcattcattgcacacataaccatcattgccattaccatcatcaccattttcattatcatcactgtcactgccaccatcatcatcatctccatcttcattatcagcaccactatcaccattttcacgtattacgtgccaggtactgtgctggcccatggtacaggtcaaggagaagtaaggacgagctctgctcctaaggagctagttatctagatgggagcttacagtctagagttgaactcagggacctttctgctccttcaggctgctggcccttacacacgaccaggactctggatttttcaagcccttatgaataactctattgtatgaatgcttctccacaccaccacagtttccctacacatgtgcctttggtcatggactccgtatgtgctgggaatgattgtcttcttcctctccccttcagtgttccctgagtgaacttcacttcatcgatcagattgcagaccaaaagctactctctcagtccttacagtcttacaacactgtaatttcttccaccatcattgccattaccatcatcacaatttccattatcaccactgtcatcaccaccatcgtcatcatcaccatcatcatcacaatttccattatcaccactgtcatcaccaccatcgtcatcatcaccatcatcatcacaatttccattatcaccactgtcatcaccaccatcgtcatcatcaccatcatcgtcaccaatttcagtatcaccaccatcttcatccccattatcactaccaccatcaccatggcaatgaaaacatatgagcattatcattacaagggctttatatggattatctactttaattctcatgaaaaccccagagacagtacttttattaacccatatttacaggtgtatgaactcagcaacttgccatagcacatttctgtgattctgtgattactgtctaccctttccagtagactacaagcttcatgtgagctagggttgttcttgtttttgctcatcactctgtgcctggcacacagtaagtgcttagcgagtattcacagaatggatagatactgaatccatcaataggcaaatacatgtccagcacctaccacaaccccagccttgtggtgggtacagtgaaagacaggaaacactataaacgacaggctttatcttctaggaactcatagtctgactgggcaaatatgatacaggcacatataaccataggttaaatgagtttcgaggaacttctggaaaaatggggactagggcaagggtgaaaagccagcatgctgtggacttggttggtggtcagggatggcgtcatggatgaggcagggcttgagtcagactaggaggggtgcagggaggagagaaaaatggacattctagacagaaaacagactcatcagagatctggggagcagaccagtttggcttaattgggagattgctctgggcagatgacacagattgaaaaggtcatacatttttaataaagataacatccacacaatgtaaaataacaagagaccaagaaatgattttatgatgaaggggatctaagtgtctcgaggaagagctgccttttctattttccacaaaggcgctgtgtggattgctacaggcagcaccgagtgcctactccatgcaggctccatgcagactggagggggatcaggggctctgctgtaacagcagtggtttaaaattaagcatttaaggtgtacagtttagtggaattagttcattaacaatgttgtccaactgtcacctctgcctggcttcaaaacatttcatcagcccccaaaagaaaaccccatacacattacacagccactccccattcatgctagcccctgataaccatcagtctgtcttctgcctctatggatttaccaattctagatatttcatataaaggcagtcatacaatatatggccttttgtgtctgcatcttttgcttcgcataatgttttccaggttcatccatgctgcagcaggtatcggtgctccatgccttgtttttgcctgctcagcatccatttatgatttttctgggaaccacattttgctttactttggactcatccttaaatctcagtttacttgggtctgtatcctcaccctagcaccagggggtgggaacatgacccaggatggatcagagcatcccatctgtctggcctccataatcaattcagggatgggccagcaatgcaagctgggtctgagactaggtcttggattgttgctggagttagtgagaaggaggggcttttctatgagatttctggcagggaggatgtcagcctagggctgctggtagccatctcatcaccatgaatatagaggttgtctgacaatggagcaaactggaaataggagacagaaagacacagtgccaagcgcttgatgggttcacttgagattctggatctcactgtgcctgaccctctcccagacttgtgtgttatgtgcttaaggcatttttgagatgagattcctcacttgcatttgaaaaagtcctaatacatgcctgaatgatttcaacttaatcacaaccatgatgtgtggggaggttcttaggctccagacagggcaggtagccagggctgtggcacaaaaatgcttcctcttccactgagccagtctgctcagagttctagagctgtctgcatttctgcaacagacctcgttactctgtcttcagactggagttacctgtctcctcgcaggtagcctttattctcactacaacacactttggctctggactttgtgcctcccttccaggtcctaggacagtgcaggtcagctgctcaagaaaagtctactgtgatgaggagacttcagggtttggaagctgaagatggtcctgccctggtagtcacgctgaattccagaaagaattccctctcaccgggcttcccacaaatccactgacattcactcaggggaattacttgaaacctcattagtaaacctacattcttagcatttcttttctgcatgagcagaaaacccacctctagacattggctactatggaagataatgacatagtacacctaagtcatcacaaaatggatgatggtgtaatgaaatggcgatgacggtaacgctggcagggaacagacttaattcggctgaaatgtgcttttcatctgtggggcagtgtggttttacctgtcaccagctgggtgacttcaaaatgttaaggagtcctctctgagtctcagtttctttcttggtaaaatacaaagttggtctagatatgggttgtaaagttagatccctacagggcggtcagacagataatggaagcgtgtgaagcagcctgaatacgaaaaaacaaggactgatgaaattagcagagaagtgaagaacacacattctgaaatgcacttccactcctttaaaataaaaaagcatttctggttgaataaaacatctctctaggatgaatccagcccataagccatcggtccagtcacaataatcctgggttaggtaattcccaaggtactctccagctttgacattctataagtcacattgttatactcaggaaaagggcatggggcaagcaatacatctcatatggatacacgggagcccagagaagactggcaacttttctaaggacacacagaggactcaacacaagggtagaaccaatcaaaagacccagctgtcctatgtcacgggtcttgctctttctctaacacatctttccacatgcaaaatctgagctcattagcaaagccatgttcttgctacagagcagtcctctctgtgtctcagtttcccccttggtaaaatacaaaattgggctaggtctgggttgtgaagttaaatccctataggggtcagacagacaatggaagacagataatccaagctcattagcaaagtcatgttcttgctgggaaggaactcagcgaagattttttgtaatacagtattaacccactgaaatgtaactgagctctaactgggtcatcaaaggaagcccctgagtttaggaaaataaaaccctgccttgactctggctagtgctaattatacaaaaatgtccagtcgatgcacttaaccatgcttgaaactttcaattttagataatttgtattcaaacttacatggttaccagactaaccatgagagacagacagagaagaaatacaggtgagaggactagcaaaatttttctttccagtttttaatttcatgttccattatatgggataatagcatcgtcttgcaattttaatgtgatgtcccggaccataatattcaaatacaatatttatgcagtcatctccaaaatgaaatattcatgggattgggagatgggttgctgtatttatcacattcaaaaactgatatgctgcaaacgcatgctttggttaactaagagtaaatggagacaaccaattccctaggtctcagaaaagtttctggagtcacaggggtgaatggggacttaagtcttggactaggagatggtggcagaggcccagcaacagggtatctaccaggggagaggcatcagctgtttgggcagggatttgcattttttcttccctttctttaccataacttgaaaaggtaaaattggaaggcaaggtaagtcagtgaacacctgagtgactttttataaaatatggctcaccaacaaggggcgcatggctctctcacctgaggcgtgaagcacagatctgtagcaataagccccatatacaaaaggtgaccaatgatacgctcttccttttcatttcccattgagtaggttacctggggcaactggggcaacaggtgacactacagcaaacagacattgggtgatctaggtactaatcctgcctctgcattcacaggctatgagatgtggggctggcttaacctctctgaatgccagtttcctcatctgtaagataagccccatgacacctgtgtcttgacagcctcctgaatcagctgcaaagtgtgatggatgatgcttctcacagggccttgcaaagtgtttagtaagcgctgttcacccaagcaatgaaccgactcaaccatcaatcccttcttacctaaggatgacatccctcccccatgcctggcatcctcaatcctcctttcatgctttgtatttctccacaggacttttcactttctaacacaatatacaagatatttatttagtctgttgtctatttccactcactagatgtaagctgcaagatggcagagatttttgcctatttttgttcactgctgtatccctactgcttacatcagtgcctaccatacaactggtgcttaataaatatttactgaaaaaatgaataaaaagaagggtaacagccacacctgttgggcaatcaggcagtcacagactttcgttaactaggtattggatccttctaacacacatttaacagaaaagaaaattgaagctcagaaaagttatgtaactttcccaaggtcacacagccagaagtcttgaatttaaatgcaggtctagctggatccaatgcaagctcttaactactctgccatctttgatgccctgattcaccatagtcccaccaaaaagatagaaagaacggatctgtgatcttctaatgcttgaaaaagacaatgcccagaaatgagagagaatcaaaagagaagggcttattgttggctttggaagaatctttctgccagacctctggaagatatctgtcttctacctgaggtcaaatatgaaatcatttgcattcagttttacttcctaggctatgaggaaggggcagctcaccttcctgatatttttacctattagcacactaaggaaaaagtcacagctaaatatgatcctattgggacatcccagggaccaaatctactcagctgagcatcaaagtaaatcagacagagggtgggaagaagtcctgattctcccccatgggagaagaagtcagttaaaaaaacatctgtggcttttggaaataatgtcagaaaggtggataacaaagaagtttctcaattcagttaattcactggctacaatcttggtatattcatcaagtatggaattattccagaattaagctgtcccactgtaagttttagaaggaataactctgctcttcaagtttacagcatgtctgagcaagaaggaatcttcacaagcagctaatatagctaatgctacaaattaaaaaaaaaacaacctgagaatgaaagtacaaatgatacatccaaagtcacaatgcctagaaaaaataaaatctcccccttttctgttttcctgtctggtaatctgtcattgaatctagattactccttcagcataagtacaacctaaggattttagttaaaaaataaagtcatggaataaatcatatagacccacaatgcatgaaatcagtcagctatgtgaacaggctcacacatctcttcctaggctctcaggaaagggcagtttagctgcctgagatttttctctactggcacaaagtcacagctaaatattattctattgggatgcagtggcaagattttgagtcctggaatcagattacttggcccaagtcttgtgtcttctactaaccttaggcaactttaatcatatggtactttggtttctcacaggggaaatggtgatcataatagctaattcacagagctggtgtgatgattcaaatgagattgtatacagggagggcttagcacatagtaagggctccataatgtccattacgatgctttatgtttttttcctttatcagggtgaatttctatctgtcctattctctcttctgggatttggtagacaggtacataggacacctccacagctaagaagaaatcctttagtctggcagagcaatgatatttcagcaccaaggacagaagtccttgttttagttgtgcaatagccatgattgtggcatgaaggtgacaagtgtcctggccatccttctaattctgtccaagctctggatgagctcgcgaggattcagctccctgattttgaagtttggcagttcctcagggcccctgctagccatttctctcaggcccacggtaggctgtgccccttctgggcctgagctggagtcaattgttattcctctatcctacagtagctggaagatcaagaatgcttgaggaattcattcctttagcagcactagagagcaccttcgatattccaggctctgctctatgcactgagaaaatggttttaaataaaatggacatcaccccgcccttctctctcttctaggcaagacaaaaagcgtaaataataacagctaccatttattgagcgtatactacattctaggctctgttctatgcacttaatatatattcttctgtttagaattcactgcaaccccatgagggctcattttacaaatgaaggaacagagacacagaaaggttaagtaaatttcccaagacccacacagctggtgagtggcaatgaggggaatcaagccttagtgtcaggctctgcattccacactctagccacaaggttctaataagtaagtagacatcgagaaatatgaaacacaaatataaaattacatgctatataggaacaaatatgggggtaatgatagaaaataaagagacagggacttaattagtggagatcattggggaaggcttcactgaggagcaggtggcatgcaagctcaaagagaaggaatcagtcctctaaggagttatggggaaggcctttatgagtgacagaaaattgaaagtgcaagggccctgtggctgccaaaggaagctacagggaagtcctcagcttcagaacctcacttcataggggccgacttgatctgattggtggaagggacataccacccacaagtccacgtggcttggatatggagggaaactccgcagtcagcacccttagggagtcagtgcagcatggtggttaagcaccctgacttcaggctgggcgtggtggctcacgcctgtaatcccagcactttgggaggccgaggcaggcggatcacttgagctcaagagtttgagaccagcctggacaacatggcgaaaccccatctctactgaaactacaaaaattagctaggcatggtggcacatgcctgtaatcccagctacctgggagactgagacacgagaatcgcttgtaccttgcaggtggaggttggagtgagctgagattgcactccagcctgggtgatggagcgagactctgtctcaaaaagaaaaataaaaagaaccccaactttggagtcactctgcttggcttcaagtctgtctcgccacctatgagctgtgtgttatttaatctttctagcctcagtgtccccatctggaaaatgggcacgatgatgatcgcatttatgtcatggggttgttgtagaaagagtgaatatctgtaaggtgcttaggataatcagtggcacatgtaccagttattattgctgccctgtgtggagaaagctgacttaggtttgacattcaaggatgatgattagttcaatgtcagaaaaggggagctagggaggcagctcagatgccatcccggcctccaataggagaatgctgcctctggcagatggggttcaggccagagaagagagagaaacttctctataccacttctgacctggggctggaatctacctgcctggctttcttatatttcccaaggagggcagaaaaagaagctcaagtagaaatgcagagtcagtggcctgaatcctgaggctggagtacctgggcttggtggctcacattcttcacagggctcacgtcactgaatcagcttgcatcgccaagcgtctaaaggtctgttgagggctaattggttttccacatttcatgtatttttgaaaacattgtttactgccttttttctgattataaaaggaatgcatagccttgatagatggtttggaacataaaaaaatgcaaagaagaaaataaaaatcatactctacctttcagagatgacactgggaatgtacttcccctctagtcttttgtctaacttctttgtgtattgtttggaaagaagaaaagttctaaagatgacctaaaaacacacgctgaggcccagggaggtatgtgtgtgcagttttgtgtgggtgcctacataatgccagactttattttgacgtggctgctataattggattaaataaagtgaacatgcaaacagtcatgaacgcatcggttgggtttaaggaaagcaaaagagaaatgcaatctgctttccctattggagatgagatattaatgatctccttgcatcagtcatggagctacaagttagccagaaacagagctcttctctcaataagcaagctggcaccaaaggccttcccgaatgcggatttgcctggaggaggttcctggccaggctctcgactgatttgccaacttttgtttaaacatttgcttgtttatacatcaaaggaggtttgggtctgatgattagttcaatgtcagaaaaggggagctagggaggcagctcagatgccatcccggcctccaataggagaatgctgcctctggcagatggggttcagaccagagaagagagagaaacttctctataccacttctgacctggggctggaatctacctgcctggctttcttatatttgaaatgatagctgtttctcttactatgctttgccttactttaagcataatacccataaatcatgggttggagtggctaattttataaattgttgtcgatacatataaggtcaatacctaactttcatcacatgcccacttataaagggcccaaaagaatctcccatgtccccagtggacatgagagttattgaacataagagttattgaacatttttgtaacatcttaattatgtgtatattatcatcaagattcttctcatatcaacaacaccatcattatcaccactactaccaccaccattgtgatcatcatcaacttaataggcgcaactaactgtccccaagggcttttccatatattaattcttgcaacaactctatgggattggtatgattatcctcattcccatcttacagatgagaaaactgatacacaggtaactcacgtaacttacccaaggtcacacactgtgagtgggtattagagttggcccgtgaatcttgacagtctggctccagagcctggattcttaactgctatgctatgtgctttatgtagcatcctatacaagaggccccttaatattctgctctaagccaactttattatttttagagacatgatctcgctttgtcacccaggctgcaatgcagtggtgcaagcctcaaactcctggccttaagcgatcctcctacatcagcctcccaggatgctgggattacaggtgtgagccactgtgcccggcctctaagctaactttaaatagcttcaactgttttctttcaatgtagccttattcgaagcataatatccataagtcatggttggagcagctaattttataaatttgttgatacacataagatcaatacctaactttcatagcatgcccacttataaaggacccaaaagaatcccccatgtcctggtggcacataaacacactttgcaaaatgctgaccctaggaagtaggggaaggacctaccctcacccatgcaaaaagataattctatttacattcagcaggattttctttcatctgcacacctcgagagcgtaaacctgcaggtcctctcaaatgcagtcactatggagtaataaaagaacacaggccttaaagtcagacggaaccaggttccatctcagctctgtcgttcactagctgtagggccttgagtaaggtaaagcgactctcaaacctcagctgtattcatttctgaaatggggtaacacctgctaaatgaaggtgaaatgagaaaatgtcctggaatgcgcccagcgtggggccttcctgtggccagtgaggatgctccatctccccaataccatgatcattatttgaattttataaagatggagaaacagaggcatggcctgtcgaagccatttgctgacatcccatggctgtggtatagaagagctggcatttcgacccaggtggctggactccagcatctatgctctggcacttcacacactgtgtcccagggctaacatgggggccctggtgaccctggatgaagtggagaaattagatcaaccagggaaggaaaagtctcagaaaaactccgattttcactttccagctccctggaagaggcctgtccccacacactgagacttgaacaggtttcagagatttgaaaaacttctctgatgctccctgagccaaggccagggacttgtagggatgtttccaaatacctgattattcaggctgagagtaaacatgcggccacctgcttctgcaagccctgctgaggctgcctgggaaaatgacaattgtgctacctgtcttgcaatgtatctagtgactttacttttggaggaaagcaaggagaaacagtgaacacaaccctccccttcatttaataacagaaacaatcaggaccaatttggcagctattagaatactagtttgcctttatgccatctcttcacagtgggagccagaagtccaaattggctgctaaaggttggagatgaagacagaaggtcaacattgctattaggagctacgtggaattaaaaaccgaggcaccccgtggcctattctgtatttcactgcttgcctttgttcatccccatctctctgtctttcaagatctctgcctctgtcacctcctcttttaccagggctggtctggacacatgaaataccagaatgggaagggaatttggagactttctcatgcaacccccttgtttttcaaagggagaaaatgaagtcaagagaagcagagtagctgcctcaaagtcaccagtgcattggaagaaagcaggcctagaacacagagaggcttcatcacgtgagaattatgagcttggactctgtgaacactcacttgggtgtgagtcctccccgctgccctagtgctgtgagtttgagcaagtaacttcatctttttgagtctcagttcccttatctataaaaggaggctaatatattgccaataatccccacccagtgccagaaaattaaacatacacacagaaaaacagaactaatagagagtctgggcctgatgatataatttgcacagcttgatttagccatacctgaagtcagccctaatgttttagttacctgatctggtaatgttctttacccttaagctagtttgagctgggtttctgtcatttcccaccaaaagagttctccctaacacatcaccagtgaaagaacttgagcaagccacgcccagctctggtcacttgggagggaccatggatgatgggctataggtaggcttattcgtgcagcaggtgaggccacagctaacaaagagggaagtggccagtgaatgggacattggcttgttttactattaaattaatgctgaatcactgccctaacttccggtaaatgagaaaatcccagctggggactcacacgcaagagttggaagttgtgagctattctgtcaagaggcctttgggttttagggtcttggagggaggtgtaagaagcatttcctcagcctgagacttctttatgttgtcccaagacatctgggtaccacctgtcaattacggatgcacatcaattatacaaaatgtactcaggcacctagaggcaaaattcaggcccattctccatctatttctttctcctaccagcaacaatttagttctatgcttatcataacaatgacataatcatcaccatcaccatcatcataaacatttactatgccaaatgctgtatatgcagcatctcatttaatcttctcaatgaataaatgagtataggtctattaatattttcaaatattatgaaaccagttcagagaggttaagtcactcgtccaatgcaacacagctagaacacagtagatcagaattccaaaccagaaggtgtaacctcacagtccctgtttttaacttgtgctatactcagttcctagcacagtgcctgacaaatagtgctcagagaataaatcctgactaggctgaaatagttaatactagggtggatgtaattcacacacaagttgatacatttacaatgggctcctttctcgagacacaactttgcacaaatcacctattagctgctacctggagaagaagaagggtttttccttctctacctgagggcgaggaataccaatgtctgagccacttctgacaattaaccacctccatggaatccttgcccagccccactttgctcctgcagctatggggccagaaaaacttgggttcaaattctagcatttaaccagctgtgtgatcttcagaaaaatcaggtaaactccagaagcttgacaaatggggagaataattcttacagctgcattgagtggctgtgaaaacaaatatggatcctatacaaaaagggcccacttagtaggaacacaatacacagtggccatgattcttcttactcatccagccaggcctctgtactcttagtggcctgagcgtagtaaactaatctgtgctaatttacagagcatcttcaagttcgggtgttgcagaaagaggcctcctttttaatgtaaagaaggtaggctgtgagtaggggcaggaacaatccataaatagcagaatgaaatcaaagtttcaatttagaaaaatgatacaacacaaggattctagggttacttttttttttttttctattttgagatggagtctccctctgtcacccaggctggagtgcagtggtacaatctccactcactgcaacctccgactcccaggatcaagcgattctcctgcctcagcctcccaagtagctgggattataggtgtgcaccaccacacccggctaatttttgtatttttagtagaaatggggttttaccatgttggccaggctggcctcgaactccagacctcaggtgatccgcctgcctcaccctcccaaagttctgggattacaggccttgagtcacggcacctggccagattacttctttaaagctcaggagacggagctacctgcttgcttttgttcctcccatgctgtggataactgggtaaactgtcacagagccagccaaaatgacactcccaccaacaacagcagtgaagatttaaagcagagattacaaacagagatgtggtcgggggccaggttggggaacggggacaggcaaggaccgagcgacctaagatccaggaaataactgccatgagaaaattcaggcacagacttaatggaccttcagattttttaagactggctagaaatctggattttcataggaaatactgctgtttttaaatggggctattaattttcaaatgaagcacctgaatgaaaacaagacaaaacaaaacactctgagagctaaaccatgcacgttaacaagctgaaatgatcccaagcactgccaggttcaatgctagaacaagaccccgggatgtcagagccaccctggactggtgtttaatggtgttttctttttttgttttcttttttagatggagtctcactctcttgcccagggtggagtgcagtggtgcaatcttggttcattgcaacctccgcctcccaggttcaagtgattctcctgtctcagcctcctgagtagctggaattacaggcatgtgccaccacacctggctaatttttgtatttttagtagagacagggttttaccatgttggtcaggctggtctcaaactcctgacctcatgatctgcccgcctcggcctcccaaagtgctgggattacaggcatgagccactgcgcctggcctttaatggtattttctattggaatgaggaatcccatcacgtgatgtcacctacagggggcgctcaatactgtatcccttccagttgatggaccatcatggagacttgggctcagctcaatgctgaactgcagagatgctatttttttgacattgttcattttaagcgagagaggtgtgagggatctgggttggggttctgggtgcctcccacccctgctgatgtgttggacaccagtgagggagtgaggaggacatggggctgggatcaggacccctgggttcaagtccatgctggtatgacactcttttccactacaggtcaattccctgagaggaaggacttggtcttgtttgcggctagaacagcaactggcacacgcccatgcttgttaagtatttgaatgagtggctgactgaatgaacgatctggggacgttgcttacattatgggcctcagtcttcccatcaataaaatgagaattaaccgtgggtgccctactgaaagggttgctgcaatgagatattggacttgtggaagtccttgggggaagtaatcaaaagggctgtcacaccatgagaaacatctatggttatcttgtccttggctgacagaagggactacttcagatcccacgcagacacagcgaaggacagctggtgccaagcctttctcccaccctcaacctttctgtggctgcatgaaaccagcctagaaaattccccaaatgatcactcagattttcatttccattttgtacaggggtaggggttgaggtgctaccttgcattgtcccggccgtgtgacttcaagaaattcatatctcggtatcgggagagaaacgccaccaactggtcatttgtcctgtggaaacaaaccaaggggagagtcaggccagacaccgtgggtactgtctttgtcacagaaagcaagtttcaccaattatgtcagtctgcttgaagcaccttctctgatcatttgcacacaggctgataaggcatcctctttatatcgccatttttatgtcaccatcactgactctatcacactatgttaaaatgggctgtttgtgcatttctctcctctatactccaatatactggagactctgtgagggcaagtgtggtgctccacatgtttgggaatctccagtgcctggcactgggcttggcaaacagcaagtcagcccaaagctaaatgcacagcaacctcaggacctttgcatttgcttgcctgggaaatttctcccagtattgctggcttggctttgtcatcaggtgtcctttcaaataccacctctttagagagaccttttctgaccacttaacctaaagtagtacctgcctcccgctctctccccacctttattacatcactctgtttataatacttcactcttgtatcaccagctgaaagcactgaccttgcttacattagaatgtaagttccacgaggacagagcccagctggatttgttcaacactggcatacagtaggagctatattaatatttgttgaataaacaaatgaatcaaagtgatgtgtgttcaaactgactccttcaaatgcactttgagcaatgaatgcatcaatgaatggacggataccaagtcctcgataaccacggggctactgattgagagagctttaaaaaatatgaagtccaatacaaacgagtgacatcgttgccagcattgttatcccaaatttatccccatcaatctcagcactagcagtgtaatcacagctaatccgcttgcgcatacagctgtgacagtattttaaaaggcagtcacacgggtctccatctgccagaaacgcagtcgcctcttctgctgaataaacccaaacaggtaaatggtgctgatgtgacagctcctttatcaccagccttctctgcttcggaatttttacttcaaaggaaagcgttaactattgtttcaaatgggaggaacagagaagagagcagaaagataaaaaaacatctctggggttataatagaagctagaccttcgagaagcaggacagtgctttagaaagcaatgcttgggcagaaacagaaagatctggggacagatcccagctccatgactgagtcagctgtgtgtccaaggatgtcatttaacctcactgaatggcagctttctctgaatgcgcctaggttgaaaattaaacatgcccagcacctagtaggcccatcatgcatatatactgaatggacaactgggtggatttaaagggcacacagtaggggcacaatcaatgcacgtcgtcctgctctgcctcccaactctttggtctgagctgcccctactgctcaccccctccttcatttccctgcgcctctgcagtctcgccactccaagcccctgttctctcattggatgactcatgttgaccaactcataattccagcggagggggcacaaagcagttaagagaggcagcagtgaaaatgagcgctgctcgtgtcccatcctattactgaaataaacaccaattcaaaaccagccattctagcagcggcaggcaccagaaacaccccgtgtgtctgcagggagttgaatacagcacacacacggaaagctaaaccttgctgatgggcacagaggtgaacccaggggatgctcgcaaagggctaaccccacgtgtccctacaatggtgcatctcccgcgtggttaaaccccatcgtgcatgccaaggtaaagtccactggtgcctccgacactgttacctgtagtttgtggggacagagcctctttaataagtcgctgggagaggtggaaactaaatcggcctataaaaaaatttaagcaatgtttctctccaaaccataaagaggcccattccaactgcgttttaacagctcttatttaccaaccccctcaccactctccgcaacagttcattattgttgtcctgatgaatacgagacaagttaacctctgaatgggtccccggcagttggaataataaataaggtctctcagacacccttagtgggaggattgaaggggccgggccggggctcctgggcccccttctcgtgaagcctcaggtctcccagggtcagcggctgcagttccatttggcaatcccagaaagcgcctttcagggctgtgagctggggccattttcacatttaccgcttcaccgagtccccatctgacggggatgaataggcatttagcgaatttacttagcgatgcttccacatgaaatcgtctcaaaagatgacatcttgggggagggagggtggatgaggagggggctgaggtttccaggcccagagcttttgggcaaagccgcctttcaaagccaagcgctgtgtgcttggcaaaggatcctgatggattgtctggaagggtggggcggggggacccctgcctaccccccttgctagggtctcgggcccctcgctctccctctgtgtgaaatgcttgctctgaatgctaaagcccatccccccagtccttctccaaagggagatggaatttggctgaggaccaaattctcctattgttgctttcagacgcctgtcgataattgcctacataatatttagttctctccagataattaacagcttgcgatctggtgacattttaccccgttccagtttctcgcgcgctctctctctctctctctctcttccactcacacacgtttctcactctctttttctggtgaagtcatttgccaaatggttcccatagttcatctcttgtatctatctcatcatcaatttcctcctactttttgctgaaatgattagaaatcatgtctcttggtctatgccagttcctctgcttcctgaggataactggggcctgttgctaccaccatgggagtcactgggaagtctctgctgaaataagtaagaaataaatgttaaaataaacttactgggagccatatgagaatctttttcgaaatgaataaaaaaatgagtaatacaataatctcccaagtcccagccatttactaaatgtgcaccatgccctaggccatggggaaagacttttgccacattttattgcatttgatagtcacaatgatgctaaaaaatgtaaattttggctgggtgtggtagctcatgcctgtaattccagcacttggggaggccgaggcaggtgggtcacttgaggtcaggagtttgagaccagcccggccaacatgatgaaaccctgtctctactaaaaatacaaacaaattagccaggtgtgggcatgtacacctgtagtcccagctactcaggaggctgaggctggagaattgcttgaacttgggaagtggaggttgcagtgaacacagatcgctccactccactccagcctgggtgaaagagtgagactctgtctcaaaaaaaaaaaaaaggaatttcacttcactctcattttacggacgggcaaccgagacttagataaatcatccatttagtaaagtgcagaaccagaactggaacctggggacaaatgtcacagcttgtgttctctactacgagactgcctctacaaatgatagtgaatgaacgagtgaatgaatgaatgaatgtattccatttcaagtgcagaagaaaaaaaatacaggcgcaataatgtcttcctcttcatagcctggtctgcagcccactgctattagaaatgccatacttcaggccccacccaatacctattgagcaacagagctcacccaatatctattgagcaaaaatgtgttttcaaacaagattccagatgatgcatgtgctctttaaaatttcagaagcattgctgtaagtcatgtatgactatgagtagttaattctctgctttccatctttatctgctcctcatggtttcttctggagaacccggactatgaatgaattactttcatttcaataagccttaggtcttgagagtattaaataaaaacaatgcacctaatatctgtgccacagtacttggcatatagtaatcccctgataaatgtcagctattatataatagcattattattaccatcttgaacatcagaagcttaagacaccttgaactgtggaaaacagtgtaaagacccaacctgatttgaacttggaaggctttctgtgcataagacccatggaatgttctgcagagcatagtttaagagatgtccaaggccccttcctggggatttgtccaaggtcccttcccagctggtgtcagacttagggactggctcccagagggccatggcaccattgtgtgtgtgtcttatctatataacagctctggacatgaagatatgaaggaagagagggcagagttctcaggttcccatagcacccaggagcccaggctgtatggaaaaggtgccctgggcacacagaggcacacaatgcctgtttgctggtggcatgtgacaagagatgaagcctgctcagcttccactaggaaggagcccaacacaaagccaactgcacctctctgggctcccggtgcccacctggcactcatgccccagaaccccttcccgactgcaggatactgtcaaggaccctgccagaggtgctcacagcccaacggtgaggtgacaggactaaagccaaagttatacgcaggattttgtgaatgtcaggattcaggatttcaaacctctgatgctgccaggtgtgcacagagcccaggggacactggagtaagtcctcctggactgcaatgaacgacccattgtggggcagaaacacacatgaaagactatggggaggccaggcatgcctgtaatcccagcactgtgggaggccaaggcgggtggatcatttgaggtcaggagttagagaccagcctgaccaacatggtgaaaccccgtctctactaaaaatacaaaaattagccaggtgtggtggcatgcgcctgtgatcccaggctgaggcaggagaatcgcttgaacccaggaggtggaggttgcagtgaggagagatcgcgccactgtactcccacctggaaaacaagagcgaaactctgtctcaaaaaaaaaaaaaaaaaaaaaaaaaaaaaaagaaagactatgctggtgcatgagggactgtgaagtcaggcaagttgaggaagttgagggttgaggtgctttcaacctaagctgagaatagactacaacagtgtttccccaacttctgcttctagtgtacccataatctttaagttatttcatatgtctatttaatttaaattctactttagctttatcttatgcaccaatgtttgtgatatttgatgtcacaaatttttttttttttttggagacagagtcttgccatcttaaccatttttctgagatcagacgaggttgggtgtgttcagggtgatatgtctgtagaccatcttaaccatttttcagtgtacagttcagtggtactggatggattcacattgttgtgcaaccatcaccaatatccatctccagaactcttttcatcttgcaaaactgacactctctacctgttaaataataattctctatttctctcttctatagcccctggcaacccccattctacttcctctctgctattttaactattctaggtacctgacataagtggaattgtacaggatttgtgttttgctggctgacttatttaactagcaccatgtcctccaggctcatccatattgtatcataccttagaatttctttcctttttaaggctgaataatactctctcatgtaccacctgtatgttatttttttccctgttacacattaaaaacattaacgaccacgtgtctgtatacttcttaaatcaactgggctaccagaggcacatatggaagaggtcaactgtcctggtttgcccaggactgagggagttcccacaacacaggacttttagttttaaaactggatggtcctgagcaaatgaagatgagctggtgaccccaggcacatggctccattgagggctgtgtaaccacaggagaagtgcacactccacagaggcaaaaatctcaccctcctgtgatcaacccaatgtatagaaaacaagataatggcagggcctattgtaaccttttcctatgcctttaaaatcattatgaaagcttagatcacagcaagataaagactgaaataccagcaatagcaacatcatcatcatctaacacttgaatgcctcctatgtggtatttgcatctattaacccacttaatcctcatgacaaccctaagaggtagatgctattatatttatatccatttgttattatataaacgggaacatgtatatacatggatttttgtgtaatgacctatgctgcttctctcactcatcagcacgtacaggcagacttcatccttttaacggttgcacaggatcctatagaatgggcgtagccagctgggcatggtggctcatgcctgtaatctcagcactttgggaggccaaggcaggcggatcatgaggtcaagagattgagaccatcctggccaacatggtgaaacctggtctctactaaaaatacaaaaaaaaaaaaattagccaggcatggtagtgggcgcctgtaatcccagctactcggaggctgaggcatgagaattgcttgaacctgggaggcggaggttgaagtgagccgagactgtgccattgcactccagcctgggtgacaagagtgaaactctgcctcaaaaaacaaacaaacaaaaagaatgggcatagccaatgccctagtgatggacacttaggtcatttccattttctcccccttacaactactgctccattgaacacccttgaataactatcttttcacatgtgggcatgataggtttctgtaggatcaaatttgcagatatggaattgttcactctaggattatttttcagtctttaatttcagaaagcaaactacacggaatgagacttctctaagaattgcccaagactcacatcattgcacagaaaccaagcctgtggctgccaggagcatggggaggaagaaggaaattgcaaaggtgatggagttgggatgtcttgcagagctggcaggctcttggctcctccagcaggctggtggggttaagcaggggccttctgggttccccaaaggaccaaccaccagcggaccctggaaaacaaaggaggctcacatggagatggaaaggaccttctgtcaagcaacggggtcagggcagaaccatcctctcccatgcctggagcagctgctgcagctggtgatcatctgtctgccaacagaaccagcatctggactatggggcagcacctcggacagtgcttttcaggaccatggctgtagtcctgggatgagcaggcattgagtccaattcccatctgttcctccaggacctgacacatagaaggtgctaagtaagtattcactgcttaatgcaagcccaagtagaggcccggtatgcagggttcatctctgtggcttctatgctcagcacagacagtacctgccccatgggaagggctcagtccatcattcacttttttttttttttgaggtagagtctcgctctgtcacccatgctggagtgcagtggcacgatctccgcttacagtaacctccacctcctgggttcgagagattctcctgcttcagcctcttgagtagctggaattataggcgtgcaccacaatgtccagctatttttttttttttttggtatttttagtagagatggggtttcgtcatgttggccaggctggtcctgacctcaggtgatctgcctgcctcagcctccaaagtgctgggaccacagacatgaggccctgtgcctggcccatcatccacttctgtatccacatctctgcccattccataccctctgccaggaatgctcctccctacgtctttgcccaatgaactggggggtgatttgggggaaggaatcccagagtcagggtactcatgagaaaatgcttcataataacaattgcagaaagatttccctttgttgctcaccaagtgttaagtgctcgtcctccttaattttacaatacacatccaggaggtactcatttgcggatgaataaactaggactggaagagccttcacagcttgtgccaggtcttatgagtggtggaggggagatgcagacctcagtgccccagggccagagcctgagctgttttcaatcccgctttccccgtggtgaataagcttcaggaatgtgatccatttctgtagacagaggcaggaaataaacaggaaactgcagctgccttctgaagcctactacttcccttcaaggggactgttgttgagtgcgagtcgcacaacaggaattgatacaggtagaacctctgttcagggtgtatgtctttttcctgtgctcctgtaaaatctgaagtccagtaagtttcctcctccccctgcctcatgaatggattctaacccatccttccatctcgtgaatggattctaacccatccttccatctcgtgaatgggttctaacccatccttccatctcgtgaatgggttctaacccatccttccatctcgtgaacggattctaacccatccttccatctcgtgaagggattctaacccatccttccatctcgtgaacggattctaacccatccttccatctcgtgaatggattctaacccatccttccatctcgtgaatggattctaacccatccttccatctcgtgaacggattctaacccatctttccatctcgtgaatggattctaacccatccttccatctcatgcatggattctaactcatccttccatctcgtgaatggattctaattcatccttccatctcatgcatggattctaactcatccttccatctcgtgcatggattctaacccatccttccatctcgtgaatggattctaaaccatctttccccacggcttatctgggggaggaggagacactgccagtgctctctcctccacactccagacggtttatgcaaggaccttactgacatcttctcacccactggaaaaatcagggaagtccagggttgcagaccaacagtgaataaaggccaagttcgggacttgctgaagaagagacaagagcaaaagaactggaaaaaaggcaaatccctgattcaaatgcagtcaaagcacatgcacttgtatgttcactgaagcactattaacaatagtaaagacatgggatcgatataggtgcccgttaatggtgaactggataaggaagatgcggtacatacacaccatggaacactgtgcagccatcaaaagaacaaaatcatgtcctttgctgcaatatggatgcagatggaggccactgtcctaagtgaattaacagaggaacagaaagctaaataccacatgttctcacttataagtgggagctaaaaattgggttctcacggacatgaaaatgggaacaaacactggggactactagagagggaagaggaggagggcaaaggctgaaaaataacctagtgggtacaatgctcacttacctaggtaatgggggccttcatacccaaaacctcagcatcacacaatatacccctggagcaaacctgcacacgtacccactgaatctaaaataaaaggtgacttttttttttaaagtttaaaaagtagtccaaatttacagagacttattttgctaagatacggaggaaaaggtatgaaaaatgctaaagagtatgttttcctggactccacaggcataattccagccaccatgagcaactgaggaaaagtgaactggataaaatgctggcccggcctccaggctcctctttacctcgtcctccaggaagcagctgcaggatcttcctaaaacatgagtctgaccatgtcaccctttgactcagtaccttcagcggctctccatcatctgaaggacaatgtccttaccccttggcaaggcatgcaaggttgtttgtgacccggcactgcctactcaatctttggaattacttgaagttttctaaatgttctgtgttctttcataactctaagactgtgcaagcactgtttggtctcctgggaaaaatatgacttccacttcttcaataggtcaggccctgtgacaaacgcctgggacaggagtgggtaagatggttgtggcacctgtcctcaaggaacgcacagaacactgggggatgcagacatataggtaggtccctgtgatatgaagtgagacagcagatgaattgaagcacgagcattcaggggaggctacaaaaagtatgctggggacaccagggggacagtacctccttctacaaaggcaggcagtaaactggagaactacctggttgttacaacccaatcagttttaattggatttacctttttgtactgacaaaaatgatgtggcattaaaacacactcattgtatttgaatggaccggcaaaccatttcacaaagcctcagtgctttcacaggacatttgtaagaaacacatttttcattttaaacatacatatgcctttctaagaggcagtttatctgatgttctatcaatgagaactcttaacacaccagcccttccttcagacggctgtaatggaaaggtaactgacaacaatcagcacccaggggccacgcaggaacccaggacgccaccggaatcatgaatgaactaaactgacattctgcttggtgggttggggggcgggcggggagggtggggatcgtgtgtgtgcacatatgtatatgaagtctatttaactgtattttgattctcttaagtctgcttgtcctcacatgccatgaggcatctcaaatgtgcacaacatttagttaaccaaattctgcattcccatacaatgattgattacagccagttatttgatttggtcttcagggaaccaggggaggtccacttcagagggcatcgaaagattgaatcttaaaagtaaatgcaatttaagtaggaaagccaagacacggctacaaggaaagctgttttcagagaggtgtttacagtagtttctctctgctccttgccactttcttgccgtttgatttttagcaagttcctcaggctcactgagccttggttttctaatctgccaaatgggagcatttaacaatggtctatgagttacttgtgtgttgtgggtatggtacatgcagtgcctggtgcatagcaggtgcgcagtaactggagttccttggaaagaagtttctatattcttcgctagaaatgcagagagaaaggcatgtccaccccttgctagtttcctaccaagctgtgacatttcaattcttacacacttgtggttcctagcaaaaatttaagttatgtatgttcaagttgcttgactgtaagctacctgaggacaagaactttatctgggtcatctatgttccccaactgtccagcacagaggccaggaacatgacaggttccatcagccttatgcctatttctctttgggtccccaggcccatttcactgtagcccacggaaactgctcagcacaactgtgttgcaggacagaatgagggcttttgtccataccatccctaatgccagaaacatccttcctacacctttgcctagagaactcctgcttgcctttgcaaaagctggctcaatgtcagttccactgggaaaggctggagtataaataaccattgaatggcactgaactgtactgacacgctgacctttctctttgtgcttatggctgagaacagatgcctttttcaccattcatcctgccctgggtttattcaaataatcaccatgacctataatactaatttgtccatttccatttcaccacataggtcttcctaacgcacctacactaatgtatcagaatttgcagtggttaaaataatgcagatctgacatcagagaaatgtaggtttgagtcctagttctactacttattggctgtgtggccttgggcaggtcatttttagctagtcgatgctcaattttgtcatttttaaaattgaggataataacactatttaccttatagagttgaagatgtaatgaaataagagggaataatctgttgcttgcaactacaaaattctagctgatacagaaactggtatcagaagtcgggtaatgagtgttgagccagtgaaaacaagagagatctagtacagcttaggtaacctagcccacagaatgctagaatgtcagatcttattattgttattatttttattatcatgaattctccaggactagagtctgcactgtgccaggagtaggatacagcaaggatctctaactcccagaactttgggactgggtcagtttggatttcagccccaaggtgagattgagcttgaaggacagttgatagtgtcaccaagcatctcattctccttgggcagcttgccacattcacctgcctgtctgtattggaacaaggtcaaaatgcactgcaacacaggcaagaagtcatacacaccatggaaaaacaaacactgtggtttctgcaacacagagatcgattctggaggatcaggacatgctgcgtccagtagactctttacccacagatttccaaggttacttgtttatctcagagggctgatgagaaatttcaaaaggatttttaaacggattttttctttttaaacagaggacacaggccttgaagtaacttgacagttcctaggcaaagaaaacttcagaaatgatttaaatgagacgttatcacatagatcatcggtttttaagctgcatctgggggaaccccaggttggggctgggcagctggggcctcaagacacctcagtagaggtttccttactgaggactcacttccacccctatattgggtaaaatttcaattgtgcaaaaatggtttagtagcctaaaaacaagtgttcaaaaatcatttaaaaaacggccaatttaacttccagttctcctttaggagaggaaggaggctggcatcttactcaatagcagaactggctgagctctgccctcactaactgcccaatcttgggcagatgacaatttttctgaacagcactgttgcctttataataacaggaatcgcaatatgacatgccttgtggagttgttttggggttagaaggaatgatatcaggttaacctgttagcatgggtactcggtgtacagtaaatacttagtaagtattaactatgttactcttgcagctgtgaattaaatttctttttattccctccttccttccctcctctctcccttttttttctctccctcttccatttctctttccttttcctttgtccttttctttcctttctcttcctgcatcctgcctactcaatctttggaattacttgaagttttctgaatgttttgtgctctttcataactctaagatcctgcaagctctattagctttcctggtaaatacaatttcccagttcttcagcaattcaggccctgccataagcatttgctgagcatcttcctatgtgccaaagactgcgttcatttcttttttttttttttttttttttgagacggagtctcgctcttgttgcccaggctggagtgcagtggcgtgatctcggctcactgcaacctctgcttcccaggttcaagcgattatcctgcctcagcctcctgagtagctgggattacaagcatccaccaccacatctggctaatttttgtactttttaatagagatggggttttgccatgttggccaggctggtctcaaactcctgacctcaggtgatccgcctgcctcagcctcccaaagtgctgggataacaggcgtgagccaccgcacctggccgactgtgttcatttctgacttgagacatgaattctgctttttcaacagctgggtatcactttgagttgtatgggcccatttcattgaggacatttaagcccgggttttatttgactctacatgagctcatacctcctgcttcttgggtaaaagctgttcatttacagatatttctttcttttcccagagaggtatttactcaggggcaataccttagtcctgctccttctgcgctcctatggtgactgatacagtgctttactaacaaacaaacaaacaaacaaaaaaaaccaaattagtaacaaatgtcatctgggatctgatcacataaactctgccgggaagatgctgacacaagttcattgctcgctgatgaattattttcagtgccaggtctctgagtatttaaatggctgcattgtaaaaacaggatcgtattataaattgtcaaacaggacgtgtagtagatgaaggcagatttgtgcacgccacactacctccacgtactcattcagcaaacatttatgttacagctactatgagtcacgtgctgtttcagatgctggagaaacagtgaagatgaagacaaaatccctctgagaatggagctttggtgttccgaggcatccacgtacatcctggattagcttccctctatgcattaagagcatactagtcacataccatccttgctagaatcaagaacacaggcactctgcccacttcctgtgttttgtggctcaaatgaggaacctcagttgagcaaggcttggctagcgccatgtctggcatattatagttgctcaatgcacacagggacaaaggttgaatgcaatctccgagtctgtgccaggttcctggaatggaattcacaaactcggacagaattcctttcatgctaaggcagatacatcagcaggtccagctgagacgagcctaactgagtgacagcttgacgtgctgctgttctgcagaatcatcattcggcaaaaggtgaaataggtttaaagatcatctctactccttaatccttgcggtaccaccttgcaggtttctttatccttctgagcctcaatttccttgtctaagttgagcaaagatttgatgagatcatgggtgtggaagactcaatccagtgcctgccacatagtaatcgcttgattatctggtagcccttgttttttatttggctctgagtgagggagaagggtggcaggcttccccaggctgcaatgtgcagtcatcaaaggttttctcagggaagctgtggtccttgggatgttgacgaacccaagagttagagaccaaaccaagaccaacctctctgtggttgttccctggctggccctccagagggtggccaaaaaaataaataaataaaacacaaaagaaagatatacatctacagaagctgaaattcctctgtttttctactttatcttattacttcttccctttttctctaaagtagctgaaccacatatgttaagagtcattgtaatactgaaaagaatggaaaacaggtgttcgaacaaaacttggccatgctattcatggcagcactactcacaatagcccaaagtagtaacagcccaaatgtccatcacctgctgaatggataaagccaaatgaggtctatccagacaatgggatattagtcagccatagaaagagatgaagtactgatacaagctacaatgcagatgaaccttgaaaacataatgctaagtgaaagaagccagacgtgaaatacccacatgatgtatgattccatttatatgaaatattcagagttggcaaatccacagaaacagaaagcagaccgggggttgccaggggttgggggtcagaggggaatgaggagtgactgcttaatgggtacaggttttccttctggggtaactaaaatgcttgtaactagatagtgattatgctcatataccattgtgaatgtattaagcgccactaatttcagttgtatattatttttggcatattaaatataacttgttttttgagatgaagcctcactctgttgcccagggtagagtgcactggtgcgatctccgctcactgcaacctccacctcctgggttgaagcgattctcttgcctcagcctctcaagtagctgggattacagacatgcaccaccacatctggctaattttttgtatttttagtagagacaggctttcatcatgttggccaggctggtctcgaattcctgacctcaagttaccgccctctttggcctcccaaattgctgggattacaggtgtgtgccaccacatccagccaacatattttaatgttattatttatgtttttatttttatgccacaataaaaatatgacagttgaaccccaaaatttcaaactgagaaataaaacaacagctacaataataaccatgtttggtgtatcctacctattttatatacgctatccacctaatcctcacaacccccctaaaataggcagcagtagctccattttacaatggagcaaacttctcaaaacttgggcaacgtgtctaataatcatgatgatcataacaataataagtatagaatataagagttgcttgctgaggcacttgttacatatcggctcagtttgccttcccaacatcatcatgatgtacatattatcattatcacccattttacagaggaagatgaacagagaggttaagtgacttggcctaggttagacagcccacaggtaacagaaacagggatttgcacccaggtcatttgacctcagagtccatatgcatcaccactggagcccgcaggcgtggtcatggagccgggaaggaatgtggacacctgcagaacttacctccctgtcctctctcatggaaaatgggaacagactaggtatctgctccatgacatcaagtgacttcatgggatccagaccttcccccaggctgcatggaagccagcatatagccagacaggtgtgatatgtgaatgtccctctggcctgccaggctcccagacacagatccttgatatctgtgcaggcacctccactttatgtggagaagcagctgagccaaccttaggattcatgagtacctaccacagctcactgtccttttgaaataaactctccagctctttggaatgttttctgttttcatggtggtgaaatctgaaaacgtctctaggtgaaaagacattaagtaaagacaaaacccctccactggtcctcaatctaggaataagcccagagatgtttttaataaatggggaatgcaaaaaaaaaatgcggtaaaatatcagtgactctcctggcacttagaaataaaggaccacagccactgcagccacagtggtgttatatgggacaaacactgagcactcatttgctccttcatgccttacttcagtaagtacttactgagctctcactatgtgccaggcactgtaccaggaataagacacagtggtgagcaaaacagatgtcatctctccacttgtggaactgtcacccgggcagcttgggtcaccatcactatcatcgtttctcgagccctttctctgggtcaggcaaggtgctacacatttcacagcttcatccttacagtaaaggctgaggcaggtaactgatggttcccattttacagatgagaaaactgaggcagagacaggttgagcaacatgcccaagggcacgtggccagtaaacagaacagctggaaattgaactcaggctctgctgcctcctcaagtgcacactttcaaccgctttgctgcactggcctgagggcctgagccctggaaaattcctgccgactagcagaaggaggtttgtaggtccagttccagatccagcttacagggtctctccaggaaacccagggccacgaagcctaagaataaggtatgctgcagaaaagctcaacaccaagagaaaataatagcaacaaagcaacaggaggcatttagcctggtggaaagtaattacctgagctataatgtacatatctactagcaaaaaatactagctatcatgtttcccctcctccagcaggctggtacagtcctctactttttttttttttttaactttctttttcccactgccaagcaactgattataaactgaaccaatctcatcatggcattttctaatagaaaacttttcaaaggcttcccattgcttataggataagcttggactccttaacctggctctaaaggtcccacacggtctggcccccacctgcctctctggcctcattctattggcttatccccttgccacactctgtccacataagcctcttttcatttaccacagaagccatgttttctcctgcctcagtgcctttgtgcatgcagcccctgctgcttgcaatgttcaccgccccctttttttcacccagttaattcctcctcttctttcaactctcaggaaaccactgggcagagggcactccagcctgctgcccatctccttcttagttttacataaaaggagggggaactgatggtaggattacttagtgccagtgagattgcttgagacgtggttatgggatgggtacttctccagggaagctttccctggtcctttagaagagaaggggtgatatgcatgtctgtttcctgcattatatgcatgcaaatttctttcctgacaatgtcatgaagatgtcattatttgatggcttaatctgtatattcctcaaaggcagcgatgttaatggttctattggtgtctgtaaccccaggtcctggcaaatgtctggcacacagtaggtttccaacaagcatctgttgactgactagaatgtatgaatgaatgaacaaattcacagtgacgccctacagctgatagttcattaaaatgtattttgcggacaccaccttggttaaaaatctctctcttcctgaattaacattgcaacctgagacagacttccaagataaattacaggaggggagcccagacacatccaggcagtgagtcagtagaaaaccagacacacaagatcaactggatttatagaaagtactagaggaacacatgtccagtcactctgggaaatctttgagaattagctggcattaaggcattagtcagcaacttgcctggtcaaccaaggaaagataaacgagctctgtgcttttagcgggggagcagaaacttggggtaagtgctgaaatcaacgagtctcaggattcaatgacattaacctttttgattcagattgaggaaggtggtgcagggtgaattacggtgctaatgaggaccaggtatttatcctgcgtttaggcagagaaggctgggtggtaagaaaaccggtatgctctggctggcaggaactctgcggggctggatagccatggaggactgtctgtgtgcaaactgcctgtctcctctcggccgcccctggtcaggcaacactgatgggtgagctgtgtttcatgtgctccttaccagctcaaggtcagaaatggcacacgaagtaggttaggggaacataaaataaagggagcctgctgtttaataaggggttcagctacccaggactgggtagaaatccaggtcaaggcctaggggaggtagagcagaaggccttggggatctccatcactcattctctatccagggtcctgaagtctgaagcacttgaggtgattcagattcaaccccacctgggttgacagaatcatctaagatagtgaagcaaaggccatgcctaggaagatgggtgagtgggttggcactaaatttgaaagggctgagatgtacgtgttctgggcaaggccacgatctgaaacatgggagatctggcagaatgatcaagtgcaaactattgcctgccacctgtttttagaaagaaaattttactggaacacagtcatacccattcatttacatactgtctatggccgccttagtattacaacagcagagtttcgtcatcctgagagacatatatgtaccacaaaacctaaaatatttactatctggccttttaataaaaacttttgaggctgggcgtggtggctcatgcctgtaatcccagaactttgtgagctcgaggcaggcagatggcttgagcccaggagtttgagactagcctgggcaacatggcaaaaccctgtctctacaaaaatacaaaaattatccaagtgtggtgacatgagcctgtaatcccagctactcaggaggctgagatgggaggaccacttgagcctgggaggtcagggcttcagtgagctgtgactgtgccactgcactccagccagggtgacagaatgagaccctgtctcaaaaaaaaaaaaaaagtttgttgaatgaacggagctggaggcttttatcctaagtgaactaacaaaggaagagaaaaccaaatacatattctcgcttgtaagggggagctaaacattgagtacacacggaaacaaagaagggaagggtagacaccagggtctccttgaggaggcagggagggtgaggatcgaaaaactatcaggtactccatttatcacctgaatgatgcagtaatttgtacaccaaacccccaggacacacaatttacctatgtaacacacctgcacatgtacccctgaacctcaaataaaagctagaaaagaagtttgttgatccctcgcctgataactctcttttttgggtcattcacaatcttcctcataactttctggcatatccgtctaatcgaagtgtcttcctgacccaccctatcctctttccatgcaatagttttcctggtactcatttctacctgatatatgacccgctcacttatctactgtctctttctctaatgagcatggaggatgcacaacagtgcttgctttctttactgccatattcccaacccccagcaaaatggctggagtataccaggcactcaataagtacttgccaaatgactgaagagccacttaccccttgtattgttgccttgttaatattttctcatttaaatcaactttcattttatttatttatttactttttatttttaaggaaacttcagcttccaaaatctgggctgaacatgttcctattcccttctatgtgttaatatagataaacatggacattttcaaagactcgcctgcatttctctttaaatcatcttacatactgcaagcggcccacaggccatacttgggaagtcctgactcattgttaaggacatgggtgggtttaagctccactgagctccacttctgggtagctgagcatctgctcaagtcccttctcttgcaaatggggacaatgaaggtcccatctcaccagatggctgagagattaaaggagaacatagaagaagcacttagcacctgcagaaactcagtggcagggaactctcaggggtggggccatctcccggtcgctcagttcatgacaaagcagtgcccccttggtactgcagccatcactgtcatgaagcctgtctgagacactgccccaattcctgaatggttgcaccacaacccagcaaagcaatttggattaatgggactatttagctgtaggtgtccagagaatgcattgtttaaagtaacttgttggaaacttccccagggtggcaaattttaaacaaagattgactctgtaatcaaaaattgcttctgcttggccttaaaccagattccggcatcctgaagagcatgattagactgagaaagggtggcaatgtttgtgcccctggctcggtttgccaagtaatgttgactgatgaatacaattaaattgcactgaggagaatccctccctggaggagaaaggacataggagacgggtgatggcttttaggggcacagtttttcattccttctccataagggaacaaccaccattgtgggattccccttcaccccctaccatgggaaaactggccagtactaccaaatggccttccccttcccattctccacttttggattaactggtcttataggcagtgggccaagactagattccaggttctagagacactccatctgaccttcatgggcctgcttcacctaagctgagtgggagtgggaggaggcagcaggggagtctcatgaaccatgaagactttgctctctgcgttggcttctgttccatgatgatttcctaggaagctgacctgcccagatgtccaaatcactttctgatattgcctggggccaccaggggagggtcagaggcaggccacttgagcatggggatggggtgagggttggtgaggctgggaattggaaggaagtttcccacttgaaatttcaggtagattgcagttgcattcaaaaagtaactggagaaatgcacttgatttttcaaagtaagtggagaaatggacttgagaaatggaatatgttgtttcacctcattggggtagagaaggccagtaaacactagggctgtcttcaaacagccttgcagcagggagggaatatgggggcccaactacaggcaaagaaggctcagctcaaggcaactaccttcctcactctcatcacgatcagacttcctcaaaggcaggtgccccctgcccaatctgcatttctgtattagtacaaggaatagagacataaaatataagaggaagaaagaaggagagaataaggaaagtgaccacacaaggccagaccatgtttttgtccagaattaataactatacaggattattaattatcattgtcatcactaccattatcatcaaaaaatttccttgttaaaaaatgcccaattccggattaggtcctgtgttccactatctttcatgtttctaacaatcctatgaggaaagtaccctggggagggcactctagcctgctgcccatagcaggttctcctctgcccatctctctcctacatttacccaaagggaggaactgagggtaggattacttagtgctggagagattgcttgagacatggttattagtgggctagatatctgttctgtgaacccttcctcctcccaaatgaattgcacttcttttttttttaatgtttcttgcctcaggcctgggtggtacttaagcctcttggggccacgatgagttaccccaaccgcttgatgcaacggggtgggtacagtaagctaaggtctccctggtggattcaaccatctctccttgctttgtatccatcagtatgaccaagcatcctggtcccaatgttttgatggtgagaaggtggagaggaggtcacatggagctgccagacctgagccaccatgctctgacctagctgtcatcaaacagcttgaaataaagcagtacctggagtcccacctggctattcttccttttaccgctccctgatgggtagcatggtcatgccctctcacaggtgagaaaaaggagactcacaaaggttggatttgttgcttgagagcatatagctctcatacaggggatgaggacaggtaccttggtctgtacaggctgctataacaagacaccataactgggtgggttaaacaatggagatttatttactcacagttctggagactggaaagtccaaagtgcctgtcaattagatgctggtgaggcctctcttcctggcttgcagaaggccaccttcttgctctgtccttacatggcagagaaagagagagcgagctctctggtgtctcttataaagaaggacactccttctataggatcagggctccatgcttatgatctcattttaccttaagtacctccttataggccctatctccaagtacaagggttagagcttcgacatataaattttagtggggcacggttcaatctatagcaacaggattcaaatccaggtcaggctgatattgcatggcctcttctacatcgtagtggaatgacttgatggtgtagaatatgccagcattgctttgagtttgctttgattttgctttgaaacaattaggcatatgtggggggtggggtggggggagggacagaagccattcctttctaattatgcttgcattaggctaatatttaaatgaatgagaattccactgggcaccaccagatagccagttagggtagagatatggagagtctgaggtccaatgggaacaggattacaaaggaatttgaaggttggggttgttcttgctaacgcaggacagatggttcctaggtctatgcttagagcacacagtcagtaaagcttggatattccattagagaaagaaagagaccatctggagatgggtctacactggcttttggctttggcagccacatcgtagtgttggcatccttgggtgatcggctttccctccctggggtcaaccacttacacaacacactgcataaagcatggtgaacttcagggtcagctaagcctgcattcaaatcccagcttggccacgatcaagtcatgtgacgttgggcaagtcacttgaacactctgagtcctggtgctgttctatatgtcatcttactgggatgccatggggactaaagcagaaagtgggggcaacttggcagttggctaaacattaggtcactctggatctcaggttctgatgtaccctgctcatctcttgatacgtggacaactctgcctcctggattctcatccagatacagaaaccaaggatttagatggggaagaaatgagtgagagagctttaccccagaactatccagcaggtgaaattatgacccgttggcaaaaaactcaggtcctttcctctctgcccctactccccgtgatgaaagaagcatgcatttaaatcctggctccaacccccaccagttgtgagacactgagaaaatccctttacttctcacagccttggtttcttcatactgcgatgcagtaacactatctaccttctgggattgttgtgagaattacatgagataatgcatggaaatcacttggcctagaatcctatgcacagtaagtagtcaagaaatgtcagcaaatatgattagctactggagtatggcaggtcttaaaaggctttcccaggcatctactttgagtggctactattgaccatgctggacaatgactcagggtgggagcaagggagagaaaatacttgaatgataataagaataatccacagagtccgtctgtgtgcctaatgatcagaccttaaccctgtcgcttggatcctatactcagtcaaatctttgccctcatcaatttttaaaagggtagaaacgctcctcccttatcccacttttaatacatgcggttcctccagattgcccttgaaaagaatcttcacctgcagttagatgtaaggaacaggcaagggaagaataatagactctacaataaagaccacccacattgtagaccaccccgggctcacatccaaattcccaggatgcacttggagcatcccagcatggataccgtccatactcttggccaccggagaaaaagtcacataaaagacggcttttttttttttttttttttgccaataagcaaaaatgctcaatgcactgggcaggaagatgccagggttggaaacgtcccatccacagacacatagagagccgctgccaagaggaaggagaattgtgagatctggagagggagggattcggaagaaaatacattgcaaaattcattgtgtggtcaagctgggatctggtgagaatatcaaattggcagaggacagagaccacatttatttctgtactatttagcctggactctcttttcttctggtaacagtagtataattctctctagtggaagtgtttgtaccccatggcatcgatgtaaggttcatgagcgcacagttttaatttaactttaaattaaaatcatatcaaattgaaaatttagttcctcagtcccacaaggcacgtttcaagctctcaatggccacctgtggctaacggctaccatacaggatggtgcttatagaacatttccatcacccccgaaagttccactggacagtgctggtctagagcattgcctaatatctagcagaatctcaatgagcatctatttaatgaatggatgaatggccaagtgctctattctctgctagccaaagaagggatacacaactcaagagagaactatcacatttttccccaggactctgaattttttttgttttccgttgtgaaagaaagagaaagcaaacaaaatagcaagcaaacaaacaatacaactaaaagttatttaagccagatgatggcatcccttgggtgaagcagtcacttcaattcttgtcttccaccacatccttcccagaaggtcctaagcccatagaccactcttggctttctgcagaaccttggttttcatgagatctccgagaactctaggctcactctgtttgtccagccgatggtctaggtcacttctggccttaagaaggcttaaagagctgaccagcctaaaatacagctcaggagacccaggacaactggcaagagggaagcaaactgcatttctgcaaaagcaggagtgtgtgctccatcagcctgaaaaataacagggctgaggatatgtttattttgtgactagaggcaaacaaaactgttaacggcataattactggcatgtttttccagtctccttgtgaacaacagtccgagcagatacaccctttcaaactcacacattatctgggtggaggttttattggatggtttcgaacccaggaactttggggtctcaggaagcagagtgtgtgtctctgaacgtcccaaagaacaaaagtggtttggatgctgagaaagcagaatgcaggggagatggtcacacccaaatatctgagtgttgggccaccaagtatgctttcccacgaagtactgaggctaacattttccaacacagcatgtagcttctatttatttttctaactatgtgaaagatgtctctctctctccctggaccagtggatttcaattctcactagtacaatcacctgcagggtgctggacactttaaaaatatatagattcttggctgggtgcagtggctcacacctgtaatcctagcactttgggaggctgaggtgcgcagatcacttgaggtcatgagtttgaggtcagcttagacaacaaggtgaaaccttgtctctactaaaaatacaaaaatcagccagatgtggtggagagtgcctgtaatcccaggtacttgggaggctgaagcaggagaatcacttgaactgggaggtggaagttgtaatgagctgagattgtaccacactccagcctgggtgacagagtgaagactctatctcaaatatctcaaatatatatatacacagagagagagagagaaattgattcttggcatccacaaggaatttacattcagttgatctggaacggaactctagatttcttttttatttttattttttaagacggaatttcactcttgctgcccaggctggagtgcagtggcgcgatctcggctcactgcaacctccacctcctgggttcaagcgattctcctgcctcagcctcccgagtatctgggattacaggcatgtgccaccatacccagctaattttgtatttttagtaaagacggggtttcaccatgttggtcaggctggtctcaaactcctcacctcaggtgatctgcctgccttggcctcccaaagggctgggattacagacgtgagccaccatgcccagccgatttctttattttgagcctcccaagtatctggcgttacaggggtgcaccaccacacctggttaatttttttttttttttttttagaaatgggggtcttgctttgttgcccaagctggtcttgaactcctgggatcaagtgatcctcccacctcggcctctcaaagtgctgggataggcatgagccactgcgcctgctgaactctgaatttctgagaatcacatagaaccttgatttgacccggctgagaagcacatagtgagatgtcaagctccttgtggcagggatggtgtctgtcctgctccctgcggaacacccatagcctgacgcatgacgggtgctcaggaaatggccttgagaagcagctctatcctgttttaagagtctggctcagcctgtcttctcctgggagaccttggagtccccgtcagagcacacctgtgctaatattgcaggtgtaaggtgaagagggtctgacctgggtggggatgaagggcatcacagatggggatgaacacggagagatgtcagggttagaacgagaatacgcaaggtgcagatggagcagcaaggaagggggcacacaggcttccagctgcaggtgctcaggaggagggtggtcctattcagagaaatgggggaaccagaagggtgactgatataggataggaagacattttggattcttctaaaatgtagaagaatcagtccaggtgtggtggctcatgcctgtaatcccaggactttgggaggccgaggtgggcagatcacttgaggccaggagttcgagaccagcctggccaacaaggcaaaaccctgtctctactaaaaagacaaaaaaattagccaggcatggtggcacgtgcctgtaatcccagctactcgggaggctgaagcaggagattcccttgaaccagggaggcggagcttgcaatgagccgagatcacgccattgcactccagcctgggtgacagagcaagactcagtttcaaaaaaaaaaaaaaaaaaaaaaaattagccagatgtggtggtgcataactgtaatcctagctacttgggaggctgagggatgagaatcacttgaacctgggaggcaaaggttagagtgagccaagatcgcaccactgtactctagcctgggtgacagagccaaacgctgtctcaaaaaaaaaaaaaaaaaaaaaagaaagattaaaaaggtcaattttattttaagtgtattttatcacttttcttttctttcttcttattttctttttgggatggagttttggtcttgttgcccaggctggagtacaatggcgtgatctcagtccactgcaacctccgcctcccaggttcaagcaattctcacttattttatcattctcaccatattttatcactttaaaaaaaaagaacaaaagacaaagaggggtctccaccatattctttctcacattcactcaacccacattcttcctctaatcctctggctgcgcccctgttggcttatgattggcttttttctgacccgctctcctaagatccttgcatctcacgcttgcttctctgttctctgctccagctcctgttgaaatcctctgagtctcctgaacgaggctgttttgcacaggtgtggggtcctggtccccaaacagaaggtggctgcctggctctgagtgactaaaagacttcatggctgcttgggttcaggaagctccttatggcttccttctaggacacctgcttctgcctggaggtttggagaatagggggctctgtggatgtggctctggggtcagtagaagcaactgcttgtgatctggcctccccactcccatttgggccccactcccaactattctcccacggcagccagtacgatctctcaatgtggcaaatattgtcactctcccctaaaacctcaccgctcacagactgaggctttagtgacccaacaggacatctcaagtgcccacatgggcttgcctcgacctacctcatttgtaagaaggcaaaccctcgcctcttatgtttcacccatagttgccttctttcagatcctcagatatgccagggtcccaagctaccccctcttcctgggatgcctgcttggaacctcctcacacttctcctaaactcctacccagcatctacatctcagttcacaggctgcctcctcagggaagccatccgggccctcagtccatgtgagattcctttgcaaagtgctcatagatccttcattcctttttttcacaatgcttgcctgactttgtcatatgtgcactcctgtgatctctgtgattaatgtctgtctccttcctctattaataaccatggctatcacatggataaccctcactgtgtgctaagcacttcacatatatggactcacttagccctcaaagcaaccctatggggtggtgccattattatgcccattttacagatgaagtaactgaagcacagggactgctgtgtgcaacttcacacagctagtaaataaagaagctgcgatttggacccaggtggactggctccagcctgtacccttgaccactacgatgagggcagggctggatatgtttttcctcacctttgagttgctgcttagcacagtgtccaacacatagtaggtgctcaataaatatttttttgggtgaatgggtaaagtcagaaggagccctgtctcctgaactcatctgtgggagtagagaagtatcttcactgggctgacctaagcactttcctcctcaaagcaccccaagattgtcatcagaaggggcttggtgttgagagaaggaagaagggaaaaagggaagcttggacctcacactctactcctccacatttccatcttcaacctgaatcttccccggacaatgagaatcactgaagtttctttcccgttcagctgaggtccaggggctagcatgggtagagaagatccggtgtgaatgggaaaggccatcaggccaatatgctcagatctacaaccccccatggccaaacagtcaccagggcttgcttaacaagagtcctccagcaccactgctgggcagagtcccatatgatggagctgcatcttcttaaaccagatgaggtcctcaattcagggcatacagtgcagatacaacatggccaggagacaggggctttgggaagcttcagaatgctgagtatattgactgataattggataaacagattgtggtacaagtatatcaacatgatagaatatcagccataaaaaggaatgaagtgctgccacatgctacgatgcagatgaacctcaacgatattaagctaagtgaaataagcaggtcaccaaatgtcatatactatgtaactgcattcatataaaatgtccagaataggctgggcatagtggcttacacctgtaatctcagcactttgggaggctgaggtgggtagatcacatgaggtcaggagttcgagaccagactgaccaacatggtgaaaccccatctctactaaaaatacaaaattagccaggtgtggtggtgcatgcctgtaattacagctacctgggaggcagagccaggagaatctcttgaacttgggaggcagaggttgcagtgagccaagatcgtgccattgcactccagcctgggcaacaagaggggaggctccatctcaaaataaataaataaaaatgtcaagaataggcaaatcaagtccatagatacagaaaggagattagtggttgccagagactgaggagaggtttctgggaagtgactgcttaatgggtacagggttttcttttgggatgatgaaaatgtttaggattagagagcgtacggttgcctgacactgtgaatgtactgaatgccattcaacaattcaaagtggttaattttatgttatataaatttcacctcagtttctttttattattatactttaagttttcaggtacatgtgcacaacatgcaggtttgttacatatgtatacatgtgccatgttggtgtgctgcatccattaacttgtcaattacattaggtatatctcctaatgctatccctcccccctccccccaccccacaacagtccccggtgtgtgatgttccccaccctgtgtccaagtgttctcattgttcagttcccacctatgagtgagaacatgtggtgttcggttttttgtccttgcgatagtttgccaaggatgatggtttccaccttcatccatgtccctacaaaggacatgaactcatccttttttatggctgcatagtattccatggtgtatatgtgccacattttcttaatccagtctatcattgatggacatttggattggttccaagtctttgctcttgtgaacagtgccacaataaatatacatgtgcatgtgtctttaaagcagcatgatttataatcctttaggtatacacccagtaatgggatggttaattttatgttatataaatttcacctcagtttcaaaaaaaaaggatcatgattctacagtttactggctgtagccttggggtcaagtttcttaacatctctgtgcctcagtttattcatctgaaaaatggggatatcaagagtgcatacttcagagttgttgtcaaaacgatgtaaacaagcttgtccaaccctgccttatttggttgttctgttttgtttttttgttttaggcttttagcagcctgaagccatggtttttagtttctgtctctagtgataagcagaaaagagggatgaggaaggggctttactggcccaaccaagaaaagaaactgaggagccataactgtattctctccctcagacatccctgaattgtaaagcacttagaataatgctaggaatgtacgaagtgctacatatacatttgctgtggttgctgtgcggtcttaactacaggaattctttgacctattcgggttccactttagcagactaaagggatgtgatctgtacgcagatgcagtgactgtacatggatgcttggacttccatactgctcatcttcatttcaaatcccagagtgactgggatctgtgctgaacattatcaagggcttgacttccctgcaaagcttcctctgctctgtgttaatactaatttctctaaacttacttaccaagtagcagttgtgttttgggggatgggattaagaagaaatatgtggtaaagggccctgaagagggcccagcacacagtaggtgtgcagtaagtgtctgctctgttagtctgggggttagtcttgctcaattggtcccatataaactctggtcttcgggagactgtagagaagccctggccacctgttcctgtctttaccagctggtgtttcctactgaggcgccatggagcagctctctcatgttctcagcctgcggctctggtagtatctcaagacagacatttggatctgcagttaatgtaacttacatgtccatgtggtgggccctgatagtttggactttgttgatgtggatacccaagaggcagaagtagcaggaaaatgtcaacatggtttcccctgcctggtttctgtatacatacactgccccacatgtgcaaacgtgtgtacacaccacagactgaatgtgaaccccgggaggggccaaggacacactcaaccctcctctctttacatctgatttgccccaagacaccggacttaggaaaagacacagtgtgaggcgtgaggtctctctctctctcttttttttttttttttttttttttagatggagtttcactcctgctgcccgggctggagtgcaatgtcatgatctcagctctctaccacctctgcctcctgggttcaagtgattctcctgtctcagcctcccaagtagctgggattacaggcgcccgccaccacacccagctactttttgtatttttagtagagatggggttttaccatatcggccaggctggtctcagactcctgacctcaggtgatccacccatcttggcctcccaaagtgctggtggcattacaggcatgagccaccacacccagccgaggtctcttactacaagtccaagccaagaaacagggcaaagtgctattggcttcatctcttcctgcagccaatctaaagtaggccaggtataattccttgcctcggtaaatagaacatacgaataaaaccatcatacctttcgaggattcaagatctagcagggcctcagagtttgaaagtatccattttccactttcatccacgtgctgggtacacaaccagctccagctggagcctacgtggaccaggatgtcatgtcaacagcagagcaggagcacctagagtctctaaacactctcagcttgcgtatgccaagttcaggaatattcttcatgtccacaagtgaattggatctattctgtttttcttgaaacagtctcacgtctatctttgcttttcccaccctttttttttttttttttttttttagacagcgtctcagtctgtcacccaggctggagcgcggtggtacgatctcggctcattgcagcctctgcctcccgagttcaagtgagtctcatgcctcagcctcatgagtagctggggttacaggtatgcacaaccatgcctggctaatttttgtatttttagttgagtcggggtttcatcatgttggccaggctggtctcgaacccctaacctcaagtgatccacctgccttggcctcccaaagtcctgggattacagttgtgtgccaccgtgcttggcccacttttccctcttttgacagagatgtgagttcaagaaatactttgctactcttttaactctatcaaagagaaaagggaaagtaactcaagtcccacagttacttatagccatggagtaatttgggcatttatcaaccactttctgtcattagacgctgtggtaggtccttatcatgcaagatttcattgaaacttcctaagaaccctccgaaataggcactaatattgtgtttattttaaggtagagaatttgagatgcagaaagttgaagcaacttgcccagttggtggtggggcagaatctgaaaccaggatgtctgcgtccagggcctaaacaaggctagtgaccagtaaacaccagtgcatctttaatatctaagagaggaagaatctgcccacacccccccaccccccacagtgagggttgtgcaggggacacagggaggtgacgtcaaatcacagagcagctcacagtggctacgtcgggctggctggacccttaagtatcccccaagttttcagtgcctcttagaagtgcctgacttgggcactaccgcccctttgagaagactcctaagtttgctcattctttctgggatgggagaagtagtggttttggaagctacagatggggcggcagatggaaactgaaaacctatcagcattgcccaggatgaaaccattcatctgcaaaattcatatgtttttgtgtagggcaacttcatgaaaacaacagcaagaggaaccagcagtgcttgatgcataaagtgcctctggctatgaggctggcaaagaagagtgggcaaaggaattcgtgggaggcaccatggaaatgagatcagtgaagtagaggaagatgatgagaaaggccaagagacacagagtgacctggggcactaaagcaaaaaagccacaaataagacaactctcttttctgaaccccaaaataggttgcacgcatggcctgagaaaggatttctgggcctctcagagatacaagatgagaccttggatgtaccttacgtataaatggctgacattcatggagcaccttccaagtgtccggcaggctgctaggttctattattgtatcctgatttcacagaaattggatttacttgcccgcggtcacgctgctagctaagtggcagaactcagattcgagccgtaagcagtttgacgagagtgcaggcactcaccctcccgggtgctgagccgagctggactctttaggggaggtggccacgcaaagcaagccaacaatggcctctagggggcagcaatgcgcatgcctacctggcctcaagtggtcttgggcttaatgcgggcccccaacctaggctggcatgacctctgaggcctccactgggaatccagagaaggaagaatgtgggaactttgagcacagcccctaagactgaggaacagacaatgggggtcctcccaggaccatcctggacatccctgctgcaggcagtccagccactactccaccccgccacaagctcatggggtgggactgtttccttctgtgctttcaaggtggcctggggccatcctgccagtccagttctgctgatttccctaagaggccgactaaaagccagaaggaataccaactttgcaaccagacgaaactggttctaatccccactctgccatgcattcatcacatgacattgggcctcagtttgcccctctgtaaaacaggtttgttgtaagggttgaaacaagtgtctgccacactagctgctatgctcagcattttgggacatttccaaactcggtcccttcatggaagatggagagggaatgttctaacccctccttgccatgtacttgtctaaactcacttctcctcattcttttattatactctatccattgtttaaatttctcaaacgcaacaagtttgtttctgtgctacattgtgcccaggctgttccctctataagaaacggtgattctcaagtggagacaattttagctcccagaggtcacgagtcaatgtctggagacatctgtggttggcaaaagtgggcagggtgtgttcctggcatctagtgggtagaggccagagatgatgctacgcatcctgcaatgcacaggatggcacccacagtaaagaattatccatccccaaacatcagcagtgccactgctaggaatcccagtatagaaggatctctttcttatttccctcccaatggatcccttcttgtcttctaggtctcggttcaaagctgaatattcagaggcctttctgacctcctgcttatggccctcgagtttttctccacacccacatcttcctttttttttgttgttttttgtttgtttgtttgtttttttgagatagagtcttgctgtgtcgccaggctggagtacagtggcgcgatatcggctcactacaacctccacctcctgggttcaagcgattctcctgcctcagcctcccaagtaggggggattacaggcacgcaccaccatgcccggctcatttttgtatttttagtagagatggggtttcaccatcttggccaggctggtcttgaactcctgaccttgtgatccacctgccttggcctctcaaagtgctgggattacaggtgtgagccactgcacccggcccacatcttccttgctttatggcttgttcacaccttgcatgatgtatctttggcatgatcatctaactccatcttctcagctaggatacacattccatgagcagaggagaagtacaggaagctgcatcacttttgttcacaaaatgcactacttcgaatgtagcacggtagttgctcagtaaatgtttgttgaacaaatgaacaaaattgtggtaagtaaaattctaccagcaatgttctataaccattcccgtttatccctctgtcttatggacaaaagaaaacagttgtctttctagtgcctgtcatttttctcaggttcaaggatgtcaggtgtaccccattcaaactgaccagagattgtgcctccccagtaccttctgcagtctagggtctcccagcagatggtgggatgcccccaagcctaggaatgaagaagacccccagtgaccaagctgtgaagaagaaagcagccacttctagctttaaagagaggtaggtcttccttccatgcttgtaccttgtttgggttctgattcaaaactcaaactcttgggaatatgtgacctagatatttgatgccattaaaacatgcctgctaatattttaggtataagcatcattgtgatgctgtcttaaaaaagagatcttatcttttctagatatatactgaaatatttatagatacaattctgtgatatcttatatttctttcaaaataacccactgttgggggaagaggatgaaagtccagatacaagaacaatggccatgaattaacctgggtgacatccacgtgggagttcattacactattctcttggtactcttgtgcatgtttgaaagttgccttaataaaagttttatttttttaggaccccttcatctaggtctcctgggaatgctgaaccctatggcctcatgccatcagagggaggaagatccccctcttcacccccatccactttccttttcacccttgtcagcaaatccagatggaaaacacagtcaaaggaaaaagctgccctctcaagagaaaataacagcctggcacgatggctcacacctataatcccagcactttgggaggccaaggcaggcggatcacctggggccaggagtttgagaccaacatggtgaaacaccatctctatgctacttcagaggttgaggtaggagaatcacttgaacctggtgggtggaggctgcagcgagctaagatcacaccactgcactccagcctgggtgacagagcgagactctgtctccaaaatatatatatatatatagatatatataccgttcagaatatcattcaaagtatcatgccagtggcttccctcttgcttggactaacagccaaattctaggatcaccacgatctggcctcaaattactctctgactttatctctcttgttatgctacccctcacttactctgttacagctccactgaaccctgctgttcctcgcacaggccaggcatggacccacctctgggctcagcccctgcctttgcccctgcctggaccactttctctgtaggcgtgactctctttttcatcttcttctgttcttatccgtgaaaaccttccaggccaccgttggtaaaattacaactgtcccctacttttgccccttactttatttttctaagatatcatttaacttattttgttgtttgtctccctacttgaatggaagcttgtgatggttactattgagtgtcaacttgattggactgaaggatgcaaagtactgtttctggccatgtctgtgagggtgttgccaaaggagattaacatttgagtcagtggactgggaaaggcagacccactctcagtctgggtgggcataatctaatcagctgccagcgtggccagaataaaagcaggcagaacgtggaaggaataagctggctgagtctcccatgctggatgcttcctgcctttgaacatcagactccaagttcttcagctttgggatctttgggccttcgaccacagactgaagactgcactgtgggcttccctacttttgaggttttgagaatcagactggcttccttgctcctcagcttgcagacggcctatcgtgagacctcgccttgtgattgtgtgagtcaatactccttaataaactcctctttatatatacacctatcctgttagttctgtccctctagagaaccctaatataaagctccacgcgggttggagtttccgtctgtttagtgcactggcatatcagctaatagagctgggaaaaccacgtgctcagtctctatctgttgaatgcatgaatgaatgagtgaatgaatcaatgattctcaggtccaatcagaatcctatcctgagcgatcctgtggagactatgcatcagtctccttctgcctcgtgagttcccagccatgaccagccagagcaggacgtcagacaagactggcttggggcccttggctgccttacctgatggggtagtcggccgcactcaggttgatgaagaagtcccagggccagtcggtcatctccaggaggtcccgcatgctctgcaggtaggtggacaggaggctggctcctccccagatggtggccattctccagggggtgacgcggacattgctgtactgcctggagacctggagcacttgccgatgcaggtaattagagcgcttttcccaggagagaaagggtgatgacagtcagtggcctagaaaatacccaggcatgcccctcacccctgtcccctctctgtgtcttccctcctggttgggcacttctgagcacagtggcctttgccaagtaaatgatcctggactggagtgtctttctgtactgcaattcaaacttggattattttttacatttcaaattagctatttgaaatgcagattcactggccgcacttctgagctaatggttcactaggcttgggctggtggtgcctgggacttcacatttttaaaattttatcttattttattttattttgagatggagtcttgctttatttatttacttagacagagtctcgctccgtcacccgggctggaacaaagtggtgccatctcagctcactgcaacctccaccacccaagttcaagcaattctcctgcctcagcttcccaagtagctgggattacaagtatgcgccaccacgcccagctaagtcttgtattttagtagagatggggcttcaccatgttggacaggctggtctggaactcctgacctcaggtgatccgcccaccttggtctcccaaagtgctgggattacaggcatgagccactgcacctggccaactttgcattcatatacatgacagctgcatggggtctgaggaagacaagctgggaaatatggctccatctaaacccatgtatatttcggaggcagaatttttgttttctgtccccactcctactgattgctcctccattatcctctcacaggtctgctagaagccgaccttttggacaagacttccccctttgccttcttgactaaaggcataattgtttcaccaatagaaacctcagggacaaggtagctcgggagtcagcagggctgatgcaggtttttgttaataaagttttattggtacacagccatgctcatttgttgacatgttctccttggctgctttagcacaagggcagtgctgagtagctgtgacagagactatgtgccctgcaacacctaaaatatgtactatcttgccttccatagaaaaagtgtacgcactcctgggatagtgatatggtttggttgtgtccccacccaaatctaatcttgaattgtagctcccataattcccacgtgttatgggagggatccagtgggagataactgaatcacaggggtggtttctcccatactgttctcgtggtagtgaataagtctcatgagatctgatggttttacaccgggaaacttcttttgcttggctctcatttttctctcttgctgccgccatgtaagacttgctttttgccttccaccaggattgtgaggcttccccagctgcttagaactgtgagtccattaaacatctttctttataaattactcagtctcaggtatgtctttattagcagcatgaaaatggactaataaaggtaagctattcccacaaagtatgtgagaggcaggcagagggcattgggtagaggggagaggtaagaaacagcatttaggggccgggcacggtggctcacacctgtaatcccagcactttgggaggctgaggcgggcagatcacgaggtcaagagatcgagaccatcctggccaacatggtgaaaccttgtctctactaaaaatacaaaaattagccgggtgtggtggcatgcacctgtagtcccagctacttgggaggctgaggcaggaaaattgcttgaacccaggaggcagaggttgcagtgagcggagatcatgccacggcactccagcctggtgactgagcgacattccatcaaaaaaaaaagaaaaaaaaccccccaaaaacagcatttatcatttatggacaaaattgtaagtcgcagctggaaactttgaaaccaacacacacatagagacagcactctagggccacacgctctgtggagaggcagctggtcagcttccaagccttttctgaaagcaggcagtctggactagcaatgcagaaggagggtatcagggagggacggacagaccccgaagaaagcccagcaaggggtgatcacagaggcctctcaccttgtccacgtggatgtagtagaagtggtctttgtggtagatggccttgaacatgcgctgcaactgccgagaggcacggccgtggaccaccaggacaaaggcgattctgaccgggttggctggcatgtactccacggagtcctcgtcccactgcacgttcttgttggctttacctggggaaaatccaagagaacagagaggagaaagtgaggctctgccatcctttgcaggggtgggaagtttctctggtgcttcttttggggactattttaggggcacagtcatcaaattgggccttaaaacataattcaatgccacaaagcacatcttagattctcacactgtcaggcacaaaaggggttaggggaccctggggttgttacgacatagtttccattctgaggagcttaaaaatgctggaagagacacatggacacatattaagctactgaacaaggcaggaggaggtgagagctataagagatgtatctctgaatgacagaggaagaagcagttaatttcgagttagtgaacgtaagatacatgtgttgtttttgcctgtccagaattcattctcccttcttctaatagcatccaatatattgtttgttttaacggtggtaagaacagatagcatgaaatctcccctcttaataaatgtttaagtgtacactacagtactgctgcctattaatacaatgttgtacagcaggatctttaaatttacttgtcctgcatgactgaaacttcatcatccaataccttttgtggcatcatcctcctctcctctattcttagtccatatgggtggggaagacctaacttcatcatcaatttcaggggtggacctacagcttaggcctggccaatgggaatgctgattctccatagccacagtattgtttagagatgaacatatgactcaaccaagttaattaaccaataagacagaatgctagacttttgttagaactactacataagagaggttatctttttttttttttttttgagacggagtcttactctgttgcccaggctgcagtgcagtggtgcgatcttggctcattgcaacctccacctctcaggttcaagtgattttcctgcctgagcctcctgagtagctgagattacaggcacgcaacaccatgcctagctaatttttgtgtttttagtagagatggggtttcatcatgttggccaggctggtctcggaactcctgacctcaggtgatctgcctaccttggcctcccaaagtgctgggattacagacgtgagccactgtgcccggtgagaggttctttttctgttacacaggagactagaagattctatgagcctttctgttcccacacggagagaggttgcctgagaagaaaactaatgtggagtacattgccaaggggggatgagggtccaggtgcttgtggcctgccttgagctcctgcatcagtaaggctacagatcacccactgtcatctatcatgttcttttaaatccaaatcctataccacatccacttggataaatagtcccagacatattttattccgaaaatcagcctcaaagactcctctctttctttctcttgcttcagataaaaacacagcttcctagtttagtttattacaatcccaactagaaatctcctagctttcctcagcctgatttcacttgggtccaacccaatttcttaagagttctgggtttatgggacccaggacattgtcagggtagtagctgcaagtgtcccagcatctaaaccgggagaactgagatggagactgtggggctgggggattaggacatcgggagtctaagctgtcatcagaaggctgaatggttgctgaatgaacgaggctctttctacgtagttccaggagacaagacaagattgacgtagataatatccaaatcacactacacagcctctatggctggtgtgatctaactactcagatctctctgccctcgattggtgggtctcacattccatcttgtcctctggccttctttctcttcctcaaacaagctcatttctgccttaggaccttctccctggcttcttgtgatctggaacgccctctccccagatctctgcgtggctgcatcttcttgtcattagttcacagtccaaaaaggggactcaccaccacctcttttactctctttcacctcacccgcacctcttttactctctttcacctcaccggatttcaactttcttcatagcatgtaacactgtctgcaattgtttatctgtttacttgcttattatctgaacacaccactagaacattagctccaagagatgaggggctattttggccttgtttaccacagaatctgcaacacttgaacagtatctgacacacatctggttctcggtgaaacaaaagttacaggaaggcacatttgggatcagtaaaataacaataccttttattgagcattgaccagcccttgacgttcattagataatttaatcctcgtaatgatcctacaaagtaatgctattatccccgctttccaaatgaggaaaccacagcttagaagaggccaagggattggctcaaggtcacactgctttaattagttaagctgagattcaaacacaggtctgattccaaagatcatgccctgaaccactaatacacaccatatgatcatacctagagtttggaaggaaaagtttataacaattgcttttagttgcttgttgctaaccaaatactttgtaagttagttattgcaggcaggtaggcatgcatttaaggactaacataggtattccagtatttctgtattagatgagatgctgattctaggtgattaataaggctgtatcttttcatccatccatctattcctccacccatccacccattaatttattcatcgatcgaaatccaaccactcatccattcatccatccaccattccacccatttatccatttatttgtccatccaaatccaaccactaatctgtccatccatctacccacccattcatccatccctccacccatccacccattcatccatttattcatccatctaaatccaaccacttatctgtccatccatccacccactcatccatccctccacccatccacccattcgttcatgcatttattcatccatccaagtccaaccattcatccattgctccacccattcatccatacatccatttattcatccatccaaatctaactactcatctgtccactcatccatatctaaccattcatccatccaagcatacagcaaaccctccaactatgcatccagcaaagcctccaagagcttatcatcccaaacaccatccatccacttaaggtgtatggggcctttgagattaacccttgcttttccctgtagccatgaacatcttttgccatagtttttgaatgagcaaattaatgaatgtgttctgaagaagagtggctgctctgatccagaggagctggtgtttcttaagtgcctcctatgcatccattgttatttgaccctgggaagaatgcgttatcatcctctgaggctcagagaggtcagcacatttcccaggtcacacagtgagtgaggacagaggtgggaggggaagctgagtgttgccgagtccaaagccagccctgatatttccacttgctctctgcagaagtggagatttgcgatatagaggataggtgtaaggactctatgctggtctttaaaaagggcttggatgttgatgctgaggtcttttacaacttctctttagagttttaaaaggcagaacagatttacagacagacacagacatggatgcttttcttttggagaaagggcagagtcctgtgaaatcaaagacaaatcactccagcaagagagctcccttggcttaaatataaagtcatctttgggtcagacagttagtctggggagctgcaaagagaatggggaacaaaaaacccagagctcttctgagtacagctattctggggaaggggtgggtgggaaggaacaaaaatatctaaagaaaggagacatgcagagaaggagaaatagagatgcggatggggatggggggcagagggggaagacagcgagtcaggagaaagatcaaccatttactgagtgcctactatgtgttaagcaatttctgtgcatgattttattcatttctatcaaaactgctatgaaaacagagctattatctttctattgtaggcacaaggaagctgaggcttggagaggtcccagttataaagtagctgagctgagaatggagtgagtctgtgatcccagagccctgtcatggtcaccatgctcaatcaaactgtcctcatttcaaaaagaggaaaatccgtccctagaggaaatgtgtcagctttcagctgcaggacagatataacaatgacatgtggtcagagctatgtgggtctttatgaacacggaactctttgaaagaccaaaacccaaacagtgcccagctccaaaaaaaaaaaaaaaaaaaaaaaagaatttaacaatgtaatcagattcccatggcacaaaacagaaaataagtggaaaaatcagagtgattagaggcagcaggagaagctgacttcagatgaatgttaacaagccaggtttatcgagagagaatatcaagtatatttttgcagtgcaggtgtgaaggctgaggatgatggggggtcccggagagctcccccagtagatagctgtgctgtgttagttctgttactcaaattccctatttcttagcagcattgtgggtcaaacgaggactatgtaatccttgggctccaaagacatagcagagatgaaggtgctttgcaagggtcaacatgctgttccactgttgtggtgctggcaaagatcatgttagcagtgtcctgcaataatgatttgggaggagaaagcaaggtgcaggggtttagaacatgacctgtggtcaggcagatgtgaatgaccttggaccttttatgcaatctctccaagccttagtattctgatctgtaaaatgggtatgtataatcacagaatccaccccacatggacattcacatccagaagagagagcacagtgcctggcatctagcaaatcctcaataaattatactgtcatagccatcatttctatgtggctgctcatccacgatgatcaggatttaaccaacaggcccagctccagagttctacctcaaagctgcactgactcccagggctgtgtgtactctagagcctgctgcttgtaaataaacatctacaaccggaatttccctctgcagcgtatgcccagaccacaattaataacaaatgtgaaggagctgcttgactggaatagttactctaccaacaaagccctcgattctatttatactctgaaagggctgcttccggctgctgcaaggggcactttctgacttacttccaactaagagggttagttgggtcttgggaacacagagacatggaaacaaggttgtatgcaaatgaggcttgggttaggaagctcccagctggagcccagcttctatgctgcctgggaaggtgtgactgggattcagagctggggtgtagaatgcaaccttgcactgtgtggatttaggaaagacaccgcccctctctgattgtcagttcttcatttacaaagtgggaagagaggtccatctctgaccccgctgggttccagggtgattcatgatcacagatgaggaaaagtttcacagcggcagcaggcgcgttgcagaggagcgggattcgtcttactgggggagaaaacctgcacgctcaaggttctttgttagatctgggtgggagatgcctttatcctagtgggaaattttaaaagaggttttctggtgattaaacttgggagctgtctggtgcccagaaagaatcccctgctctcgatgggtttagaaaaggcggtgctgtgtggcgacaagcatactggataaagagcaacgaggtggattcaaattcctgcttctgctgtgaaccagccacgggggcctgggcaagtcaatttctttccttggtcctgtagaatctcaaagactagtaacgctatcagatgcatgtcaaatacttatcatgcttgcgtcaaatacttctcatggtggcttgcgtctgtaattccagctaccctggaggctgaggcagaaggactgcttgagtccaggagttcgaggctgcagtgagctacgatggtgtcactgcactctggcctgggtgacagagtgagaccctgtctctaaaaataaataaatcagaaataaacaaacactcattatggcctaagcaccagtcaaatgtgatctcattatttaattgtcccaaggtctcaggaggcaggtgccatgttagcagttggtgcgagaatggaaaccaccacttgggtgtgccagactccaaaacccctattttggaaaaacccaaatgagggagatgaaatttctggatatttctggaaatttctgaatcatctggaattctaacccgatccaggagttagcattgccacatagagaactgtactcccttgagagtcaggttggttttcttttctttcttttttttttttttttttttttgagacagagtttcactcttgtcacctaggctggagtgcaatggtgcaatcttggctcactgcaacatctgcctcccaggttcaagcaattcttctgcctcagcctcctgagtagctgggattataggcacctgccaccacgcctggctaaattttttgtatttttgatagagacagggtttcaccgtgttggctgggttggtctcgaactcctgaccttaggtgatctaactgtctcagcctcccatagtgctgggattacaggcgtgagccacagcgcctagcccaggttggttctcttgatacctgtcagttcgttccctatgagccaaggtcatgctcttatctcttgtaggatgccagccttgcccctggacctggtacagagctaagtttgggggagaggcctcaatgaatgatttctgactgacagatttagccagacagcttcatccacatacagggtcccggtggtggggatgagggggcaaagttgaagactcaggcctgagaggttgcccatggctgtctcctctcatccagcaaactggatggaggctaggcacccccacttttccttgaggcttttgggtggtctgtggacccttgctcagcagcaccaagccctgctgggaggaatcagtcaacggcccagactgctctgcaccgcagctgctgctcatgcggggccaccaggtcccctcccacccagcttaatgagaagagaggggtggaggggatgtgaactgggggtcatggggtccacagaggggagctgaaagaacataggtccaaggatgaaggtggccaagccagcacctgtcaggtctcaggagaaatgacccttccttgggaagccctccctgactctcttccccatcccttcatttaaaaaatatttttaatgacttttttttctttttctttttcagagattgagtcttgctttgtaacccaggctggagtgcagtggcatgatcataggtcactgccacctcaaatttctgggctcaagggatcctcacacctcagcctcccaagtagctgggactataggtgaccaccaccatgtgggctaattttgaaatgtttggtagagacagtgccttgctatgctgtccaggctggtctcaaactcctgggctcaagcaatcctcccttagcctcccaaagtgctggtgttataggtgtgagctactgtgcctggcccccatcccttctttgagttccctgtcacagcccctctgaacatcctgcacttctctttaaaaaaaaaaaaaagttgtagtccaagataatacatgctgagtatcccttatgtgaaatgcctggaaccagaagtgtttccaattttgaattttttcagattttgaagtatctgtgtatatgtaatgagatattttggggaagggacccaagcctaaacacaaaatccatttctgtttcatatacactttatacacatagcctgaaagtaattttatacaatattttaaataattgtgtgcattaatcaaagttgcattaagcatttatgtatagaattttccgcttgtagcattatgtgcccaaaatgttctggatttcggagtacttcagattttggatttttgaattaaggatgctctacatggataacatataatttactattttagccttttttggttcgagatggaatctcactgtcacccaggctggagtgctgtggcacaatctcggctcactgcaacctccacctcccgggttcaagcgattctcctgcctcagcctcctgaggagctgagactacaggtgcccaccaccacgcccggctaatttttttgtatttttagtagagatggggttttgccatgtcggccaggctggtctcaaactcttgactgcaggtgatcagcccaccttggcctcccaaagtgctgggattacaggcatgagacacatctggcctattttaagcatttttaagtttacagtttagtataataaatatacttacactgttgtgcaactattatcaccatccatctccagaactcttttcatcttgcaaaactgaaactttctatccattgaacaataacttcccactctcccctccttcagctcctggaaagcttcattctactttctgcctctatgaatttgataaggaacctcatgtaagtgacatcagacattattcttccttttgtgtctggatcctttcacttggcgcagtgccctcctggtttgtccacgtcgtagcctatgtcagaatttcattcctttttcagggcaagtaatactccactgtatgcatatagcacaattgatccactcatctgtcaatggacccttgaatggctttcaccttttggctgttatgaataatgttgctctgaacatgggtgtacaagtacctgtttgagtcactgtttcaattctttggagtatattcccagaaatggaattggtggatcataaagtcactatttgtaatgttttatttttaggagcccatcctgcacttcctaactcagctattccacagaaggggttagcctgggtctgcatcccagccctaccatttattaggaggtcactttgcctctcatgcctcagtttcctcatctgtcaaagagaactcacctctaagtgatgctgtaagcacagctataaatgaggcaaaataaagccatacagcctgattgtggaggagttcatgtggtgtgactccgcggacctcgcccatcacacttgaacttgtaactaatcacatggctggagagtgtttaacagggacctgatcctgaggactatagcgattgtggttttgtttttgtcttttttaaattcgtaagacgggatctcgctctgttgcccaggctggagtgcagtggtgtgatcatggctcactgcagtctcaaactccaggctcaagagatcctcctaccttagcctgctgagtagctgggactagaggcatgaacaccacacctggctaattaaatatatatttgtagagaccaggtctccctatgctgctcaggctggtctcaaactcatgagctcaaatgatcctccctcttcagcctccagagtagctgggaccagaggcatgcatcccatgtccatctaatttttttagaaaaattatctgtaggctggctgtggtggctcacgcctgtaatcccagcactttgggaggctgaggtgggtggatcacaaggtcaagagtttgagaccagcctgaccaacatggtgaaaccccgtttctactaaaaatgcaaaagcaggtggataacaaggtcaagagtttgagaccagcctgaccaatatggtgaaaccctgtctctactaaaaatgcaaaaatgagctgggcatggtggtgcacgcctataatcccagctactcaggaggctgaggcaggagaattgcttgaacccaggaggcggaggttgcagtgagccaagatcacaccattgcactccagcctgggtgacaaaatgagactccatcttaaaaaaaaaattatttgtagagataaggtctccctatgttgcccaggttggtcttgaactcctgggctcaagtgatcttcccccttcagcctcccagtgctgggattacaggtgtgagccaccttgcccagtgtgttcttaaatgcgatgtcagagttacccaagagaggattcacatgctgctcacatcgaatggcattgagtcaggggggactgtgaatcttttttcaattcttacccacctctcctgaataccctaccagcaaactctcaggtcaatgcaaacaaatcttcagcagcactcccctactgaacttccttttccaaaaagcagaatcctgcccccagaactggcatctccagcaggtaacaggagtgcccggctagcactgaatgccattgtttttgtttcactgatttcttcgcattgttgctgtctcctcatggcaagtgacagcaagatttccacttatggccatgatgcaaaattacttttaaaataaaatgtgcttacataaaaataaaggcgagtctattgcagtaaaaatactacaagaataatatggcaggtggaatgtggatatggcagaattgtgaaggctggagggatgcgaaggaagcttggggaatgttaattaggctccatgagctttgcttccaaactaggatgtgctgagtttgttaaacaaatgagaggaggtaaaggcaaagggcagggggatactcaagcagccccatccatcctgcaaggacccaaaggtccagacaatgttttgatctttctggatgagggctcccacttgctttaggggcccaggagggtttgtcaggagtctcctggggtgggcttttgggacagcacctccctgctagagagacagaagtctgtggagaaacactgtccttttgattcttactctaatttgttgagtacttaacattcatgtggttctttcactcatgaggcttttacctcttgtaacaatgctgcaaatgaaaattatccccatttatagataatcatcccaggctcagagagggtgaggaacttgcccaaggtcacagagccaagaggtggagaagaaattaggatacgcactgttctgacgtcaaataccatgctctatgaccaggctttggctagcaagaatctggcatcctcatcttcactcaggctcccatgctaagcttgatgggaaccaaagcctcatgttctcagaatggcttcaaaactatcgtctcccctagagcaagatttctcaaccttggcactattgatatttgaggccagataattccttgttgtggaggggactgtcctgcgcactgtaggatgtttagcagcatcgctggatctacccactaggtgccagtagcactcacctagttgtgacaaaacctaaaatgtctccattcattgatgtgtgtccccctggtgggggatagggcgtggagaggcaaaatttgctcccagttgagaaccactgttctaggacaagctctctagatgtggtctctgatgagcagcatcagcaacacctgggaatttgttagcaatgtaagtttcagccccaaccccaaaccttctgaatcagaaactctgggtgtgggagacaaggactctgtgttgtaagaagctctccaggtgattgtgatacaggctcatgtttgcctaggccagtggttcttaaccctggctgcacatttaaaatcatctgaacatcttttttttagaaaaacatcttcatgcctcggccccaccccaataaattctaacttaattagtttggtgggcgcaagtattgggactcttttgaaactccccctgtgattctgacatgcagtcagggttgagaaccacattttggacaccttttcttttcttttcaaccatcttttaaaaaacgcatctctcgaggtggaaagaattttacccaaacatatctttggctgttgcctcaaatgctcatggccactcactccaccagagactgaaggctacctcattcattatttttctcccactctgagaaaatgtctccctccacccccgaccaagcactcaggacattttcctgctcactgacttcccccgaccccattcaagtctggagttattaaagaacagcccatgactgaaccgtcttattgattttattgttcagagccctgggatattctaatgatatactgctcaataaatggaaactggtgggatagatattgacggtgtatggtacatttcactgcaattcactgggtcccagtcacttggcctgtaacatatcatctgtgaaaacgctgcgctgtggcctgcaagctcttatccatcctgctgatgttaccttttctgtgcatcaaggatgaaagagctattatgataatagcaatgtggccactgtgtgccaggtcctgggctgagcattttctaacagacttgatatggtttggatctgtgtccccaaccaaatctcatgttgaatggtaacccacagtgttggaggtgggacctggtgggaggtgactggatcatgggggtggatccttcatgaatggtttagcaccattcctttgatgctgttctctagagatctgcgtgtttaaaagtgtgtggcacctcccctgtcttgctcttgttccggccctgtaagacatacctacatccccctttaccttccaccacaattgtaagtttcctggggcctcctcagaagcagaagccttgatgtttcctgtacagctcacagaactgagagccaattaaaactcctttctttataaattatccactcaggtatttctttatagcaatgggagaatgaaccaatacaagaccttacctcatttactcctcacagcagacctttgagggaggcattctgactattcccattttacagataaggaaataaagactctgagtagttacctgacctggtcagctaatatgctgcagaactgggattcaaccctccatctgtcagacactaaaatggggacttttaacccctgagcttctattgtattggaacaacctttcttttcttttcttttttttttgagactgagtctcgcactgtcgcccaggctggagtgcagtagtgaggtctctgctcactgcaacctccgcctcctgggttcaagcgattctcctgtctcagcctcccgagtacctgggattacaggtgcccacccccatgcccggctaattttttgtatttttagtagagacagttttcactatgttggccaggctggtcttgaacccctgaccttgtgattcgcccgcctcagcctcccaaagtgctgggattacaggcatgatctgccgcacctagccatttgagcaacctttcagagggtttcagcacagatcaatatttcacagatcctcctcccttctcaagcagtatttctcaacagggactactgtcacttgggaagagacaattctttgagtggtattatcccatgattacagggcatttgaaatccctagtccccataacagcctctcctcacttgcatttcccagtgccccctaggggaccagcatggtttgagaaccactcatctccctgggaggcagaaggcttcctgccaagatggcctcccactttttggcaaacacaggtagccactctggaaaggctacatagcagagtggaaagaagtttcgttttgaaatcggacagatctgcattcaaaccatggctcttcccccattaactctgggaggtcgggcaagctatataacctctcaaagattctagctcatcatcagtaaaatagggatacatattgaccctccttcatagggaggaactgatggatggaattatgctcagagaagtgcctagtacagagcagtagctctgaacctggggcattatgtctttcccctgtctcctatgtgctctttccaaactcctgatccatagaatccaagagcataacaagtgatggtgttttacgccactaagtttgggggggtttgctacccagcagaagtaactggaacgaatgtctatgatatgccaggcaggcaccattctgggagtgaaaaatagactcatgcacacgccacaagagcttttgcttatgagaagcagcctctcctgagaaagaagacagataataaacacataaatatctccaggaccagtatgtggtatgcagaaaatgaaatggtggccatcattattgttgccttaaataatgatttgcaaatgactacattttctcttctcctctttccaacctcatttccctctatgctcctccaatcaccctttctgtgaagccaaaatgttgtttaatctcacgaaacctctgcttctgtttctcgatgctgaggtatcctttccttttccaaagacaggatttgctaggactgaatcgtgtcccccgaaaattaatatgttgaaggcctagcctctcctgtgaccgtattggagatgtggcctttaaggaggtgattaaagttaaatgaagttgggccgagtgtggcggctcatgcctgtaatcccagcactttgggaggccgaagtgggtgggtcacttgaagtcaggagttgaagaccagcctggccaatatggtaaaaacttgtctctattaaaaatacaaaaattagccaggcatggtggtaggcacctgtaatcccagctactcaggaggctgaggcaggagaatcacttgaacccaggaggcagacgttgcaccactgcactccagcacgggtggcaaaacaagactgcctctgaaataaacaaacaaacaaaaaggttaaatgaagtcctaagggtggagccttgaatttaggggatttttgctcttagaagagacactggagagcttgctatttctctgccacatgaggtcacagtgagaagtcggccatctgcaagccaggaagagggccctcactagaacccaaccatgctggcaccctgatctcagattcatagcttccaaaatggagacaaatatttgttttttaagccacctggtctatggtaattttttttaaatgatagcccaggcagactaatatacaactcaaggaggccagggatgtgccccttagactacaattgacaggttgagtgaggagttaactaggtaagagaagagggaaaagtgtccctaagtggagggaacagcatatgcaaagggcctgtcacgaatgatagtatggtaaggagaagacatacaggaaggccagtgtggctggaactgaggccaagaggaagtgcagaagatgaggatgggccgacagcagaggcatcacacagggtcttgggtaccaccttaaggactgcaattgaagagagtaacaagccctttcatcaggcttgttatccatggttgaggagtgggtggcaggcaggacacattttgaaattcccagatggggtggtgtgggatgccttgcttcatggggtggaaagacaggcaggggcccccatatcctgcactctgtgcttcgtgtgtccagaaagcctgctctatctgtactccctgccctcttgacccagaggctgctgtgtgcaagttctcctacgagccttcctgtcgcttgacattttcatctctgccctcgtttctcctctcttgaagggactcgcaggctcaataaatactgccatggaaaaacgcagcgactcatctatttttattacaaatggagcctctcgaggagggaacaactcttatttacttctcagagggagggttttgacaacaggtttattttctccaactctccaaggattaagtgagtaacactctaaagttaacagtacattaattaatgccaaattggttggaattttcctaataaaaatcctcatagtaatcacattatgggccattaacgctgcctcctgatcataaaccataaatatgttctgcaggtgccttcttttaaaaaagggacatttctccaaatcgtttcccatttgtcacattaatgctgtcacgtcacataatgcagacaggaataattataaaagctcatgtgggtaggatttactttgcgctggtcactcggccaagccctgtacacatatcatctcattgagttcttgcagcaaacctatgaggtcctgctatcattctcattttacacatggggaaactgaggcagacagaaagagtgtaatctgcccatgatcaaatgctagcaagtaatggagctaggatgtgagtccaagcaaactgattccaggatactctgtcatcctgcctcttgaaatataaggactacatctctaagcacagtggtcctcttcgtcaagcctactgctaatgaaatctccggttgatcacaacagcaacgagcagcaatagtcaacacaacatttggttttgctcctagagggcagggatggtgtttcatttacttggcctaggagagtgtctggtgacaatgccaggagcacttggaacatacagtaaattcctgttgaataaatggacatagaaacacacatgcaacagggttcacaacagtgggtaacaacgagcacctcaaatgcactgggatctcaatagatccctctccctgcaatgatgtgagctgggctcagcctcaggccggggctctgatacacagacaaggagaccacaccacttggggagctgcagttcctgggagaaaaccaaggaggacctcgtttcgaactctgttctagcttcacttcttaggtgcttctgattgtttcttggatttctctgtctacaaagataatacttactgtagaaaattcaagcatacagaacaatatgaagtaaaaaaaaacccagatattagtgccaaaatatcaccattgttaacaaacgttcagtgaacattttgcaaatagttttatgcactcacgttatatataatcatgtatgttctgctttgtcatatgcattctgttttcagtaatgtactcctgacatcttttcactgtcagtgaatacaggcattctctctttccttcctcccaccctcctccttcccttctcaaatgttcacagagcagctacgctgccaggcactgagaatgcccaaatgaacaaaaccagtgttgaatctgtattcaaggagctgacagtccagtggatgttggatggagaaaacagatcaacgtattttacaaaaggtgttggatgcaatgaatgaaaagtacgggcggccaggggaggagagagatggggccaggtgatctgatgcaaaccaggtctatagacctttccaaagaagccacggtgaagctgagctgtgaaacataaagagtgagccaggtgaaaggatgtcactttggaaggaaggaagaccatgtgtcaaggtctcaaggcagggagggtcttattttgaataataataataataaaaaaaaaaaaagacaaaaaacgttgggggtccaggcgcagcggttcacgcctgtaatcccagcactttgagaggtggatcacaaggtcaggtgttcgagaccagcctggccaacatggtgaaacctcatctctactaaaaatacaaaaattagccaggcatggtggtgcgcgcctgtagtttcagctactcgggaggctgaggcaggagaactgcttgaacccagggggtggaggttgcagtgagccaaaatcacaccactgcgctccagcctagtgacagagtgaggcttcctctcaagaaaaggcaaaacaccaaaaaaacaaacaacaacaacaagaacaacaaaacaaagcgaaaaagcaaactcaggggtggggagaggggagtagtgcggacttttgtttttttttttactttcctttggtgcttttctgtatttttaagacttctgtagggtaatgacaagaacttactgagtaagtaattcagggccactgggtattttttcttagatgcctccaaagatggaaggctcagtgccttacatagcagggcttgtgctcagcagtgattgtgagctatcgcttccaaaatgtgcctgctcgaagctttcatccataggtcctaatttggtcttcaaagatagtgctgctgcttctctggcaaaccaacctctcaaatatgtggaaattgttattttgctattactccggcccccatctccctccaaatctaagccacctgcatattccaagctcattcaatttctctcctacaacatgtaaggtctctttgtcatgtttcttcctgggagtgactagaagatcctccacgggcacagcctgagatcactgtaaaaactttgaaatacctcccaagcatgtgccagcacaaagtcatttgttcatttgatgaataattataaatgcctgtgagtgtgctataccctggggcagtggcagggggcagggtgtgaggtggagggggaagacagcagtggacaggatggacttatcacttatttgagaaataattatcggcagggcatggtggctcatgcctgtaatcccagcacttttggaggccaaggtgggtggatcacctgaggtcaagagttcaagaccatcctggccaacatggtaaaaccctgtatctactaaaaatacaaaaattagctgggcgtggtggcacatgcctataatcccagctactgaggaggctgaggcacaagaattgcttgaaccaggaggtggaggctgcagtgtgctgaggtcgtgccactgtgctccagcctgggcgactaagcaagactttgtctcaaaaaaaaaaaaaaaaaaaaagaaaaagaaaaaaaaagagaaataattatcaaatgcctgctactgggtgacacactgcagggctgcacactggaccagatggacatgataggcgaatctctaaataaatgtgaaatgaatgaacgctacatcttgtcttttaccattacagcatcattgaggggataaccattatgctgtcttggtgcttgtattaatcgagtcaagttccctaacattggtttgagagctccaggcaggtcactcttcgacctacctggaagaccagagagaccctgatttctcaacgatggcttggaaacttcatttaagccagggggctcctgagaatacttttcttttctttctttctctttttgagatggagtctcactctgtcacccaggctggagtgcagtggtgcgatcttggctcactgcaacctctgcctctgggttcaagtgattctcctgtgcagtggctcacgcctgtaattccagcattttgggaggccgaggcgggtggatcatttgaggtcaggagttcgagaccagcctgatcaacatggtgaaactccgtctctactagaaatacaaaaaaattagcagggcgtggtggtgcatgcctgtagtcccagctacttgggaggctgaggcaggagaataaacttttctaaataagaacctctctgaatgaactgacagaggaagctcattttaaacatgagctggcccctagaccagagaactgcaggggaaagtgggtgggtcctaggattttttgacaggatgcagttaagataagcctttaaggagacagaacgtgtgctaccacagcttgggaaggccactgacagtgaaaacaatttaaattaaattaaatttagtcagctccaaaaggaaacacatgtaatgttaatttcatgggtgtaccaatgtgtaaacctaacagatgatacttaaatgagaaaggcagagaaatgacatttggttaaacaatgcatcagtgggtaggatttgttgaaactgccatttaaaaaaaaaatatgagcacaattgaaatctgagcaagctgtcacccaggccaggccacctaggcgttctcatataacacacttgagagaagcagtgggtagccgggattggaggcagtctggataaatttggggaactcaggtcaatgtctgtgttaactttttgtttttgtttttgagacgtagtcccactctgtcccccaggctggagtgcaatgccgcaatctcggctcactgcaacccctgcctcctgggttcaagcgattctcctgcctcagcctcccgagtagctgggattacaggtgtgtgccaccacactcggctactttttatatctttagtagagatgggatttcaccatgttggccaggctggtctcaaactcctgatctcaggtgagtcacccgcctcggcctctcaaagtgttgggataacaggtgtgagccaccacgttcggcctgtgttaacttctgatgctcttcctgggcttgtttgcctgggcagataaaatcatttgcttgtctctccaactatgactgagatctcaccctgggcagaaagtgcgcctttgcttgtttatgtccttttcttaaaagcaacagattgtgtagtattggaggtacatgaaaatgtggaaagattggctttctgttttatctctgtcccttggcacaaaataggcactagggcaataaatgcagaatgagtgagtgatccagacactccttggccatgttttccacccttacggcttcatggtggcaacaacatttccttgcctcttgttaataatcatcacctcctaacatattgtttggggtcctcgtccctctccggcagccatcactccttttcaatattcacagaaccatgtcctatagtcaataaagctacgggaagctgactgattggcaaaaaacaggtctctactaaaaatgctaaccccagaaacaatgcatacacactgaccctgccagaaatatattgacaaaagccagcatttttttaagcacttactatatgccgggcatggtatcaagagtgttttcggttggttggttggttggtggcaatttttccagttcatcgtctcaaaacactgagacagatgccatcattatcccacttttgccaaggaagaacaggttgagactcaagaggttatatagcataaccaagatcacacagctagtggccaagctgggatctgaacccagactaacctgcttccaaagccattactccaacctgccttaaatgtattaagaatatgttttaagcagagtgtggtggggtgcacctgtagtcccagctcttcgggaggctgaggcaggaggatcgcttgagcctgggaggttaaggctgcagtgagctatgatcacgccactgtactctaacctgggcaacagagtgagaccttgtctccaagaaaaaataaaaagaacaggtttcagatgacttataagagaggaagttgacagttcctttgtgctttacatagagcactaaaatccagtatgagccagggcaatgctgggctcaacacatggatcccaaaatcgcagtggcttgaacccaacaaaggcttatttcctgctcctatgcagcttgagcagctctcctacagggccgtcctccaagaggtgacttgaggatccaaattgcttcaactacacaatcccactccttagcacccttctcttgcagtgcacagagaggacagcgattggcatgacaaattcacagcccgtcaactggcttggccaagaagtaaccatcatttccactcacgttcctctgagggagactgaatcctaggacccgacccagatacctgggagttagtaatggagagaagaacatgggtcctagaggaacatttatattttatgtcacagaaacatactaagttatgccctaagccagcacttcttgaccagggacaattttgtctccctgaggacatctagcaatgtctggagacatttttatttgtcacaactggaagaaagaatgctactggcacctaggaggtagaagccagggataccgctaaacgtcccaccatgtacgggacggcccccacagaagggattatctggttcaaaatgtcaaatgccaaggttgagaaactgcttgaaacccgtgatcctgaaaaagattgtctgaggagcttattaaaatgcagaatctagaccgggcgcagtggcttacgcctgtaatcccagcactttgggaggtggaggcgggtggatcacttgacgtcacgagttcaagatcagcctggccaaaatgacgaaaccccatctctactaaaaatataaaaattagatgggcacagtggtgtacacccataatcccagctacttgggaggctgaggcatgagaatcaattgaacccgggaggcagagattgcagcgagccgggatcgtgccacagcactccagcctgggtgacagagcaaaactctgtctcaaaaaaaaaaaaaaaaaaaaaagaatcctgcattcctccctccagatcaccaccctggcagtatttcagtattttcaggggccctctggcaactgtgacggccgctcttcgtgaaccacactcagggaaacctcacaggaaagaggaatcaagaacaccaagcgggggctgggactaggcgctgatgaactcacacagagacacccctcaaatgcttcagggtcagtgtgaggcaactgcgccaggaaaaaaaaaaaaaaaagaaaggctgacatttgttaagtgcctctctctgtctctttcgtgcaagccttgaattgcagggaacatattctaagactaacctgtcagccagtaacaactaaattactaaccttgcctcccgctgtgccccgtatccctgtcagatgcacagtcgcactcacagaggaatgcttcctggagatgtgttcccagcattggggaagctgacccttttgcaggaacagagccacgtggtcacatgtatttcacaggggccagggggctggaaataacccaaaggaaagggaagcaactctgggcagagcagtagggcaatcagagtggttgaggctcttggtcaaaaccacgtctgctttattcatggcactcactacaacctacttcacatcgtttgcagtcaggtcttgccaagaggctgtgctttagccaataaaatagaaatgtgatgcacacaacttctaggcttacccatggacacctgtgcatgcttctctgtgctatttccctcttcactgtctgggtgcagaagagcacggtgaccttggatgctgtgtgttgaagatagtggagatagtggagtcagatggaaagggcctggatccctgaattacaacatggaggggagtcaatcaggaacatctattttggatggcagaggatgaagacatcaaccatcttcatgttagagacattatacactggtggctgtgttccaataaaatttgacttacaaaacaggtggtgggctggattcagcccactggctacagtttacccatctctggttgaagagaagctctatctaccaaataaagtactagtcttccagaaagagttatctgattagacagtttgccctgtgtgacctcaacgcaaacaaacattgctacgtttgattgttatagcagctgatgttccctaactaatatagtgattctatacctggttactgaaggcagaaaggcttgggttcaaattctaggaccagacctcgctagctctgttatctagagaagctaccagaacctttgagcttcaatttcccaaagtggaaaatggaaaggaaatactgaagaaggtaacctgacatattttaattgaaggctgtggtatattggtcatctaggagctgttgtacagatgttctgattgttgaccacattctatcagcgacaagacggacaggaggaaaagcaaggcattgagatgggtgaaggtgaaccatttacaaagcctaaactttccatacatttcttacatgaacaaatgaatgacccaacgaacacttttagcagcatctgccttctatgaagaccaggcacgtgcatgcctaatcaccctttgggggcaagagccatctgtgatttggcttgttttctttcacagtcttatttcgcagtcttatcagtgtatctgtgcaaaagattactcagtgtacgtgcacttgttagcagatgcagggaagctatcacaatttagaaagcacgtgctttatactttcaagtcaggcttccctctgcgtcctggctctgtcacttatttgatctgtggtcttgggcaaatggcttcatgaactcttgaagcctcctcagcttccaaatctgcaaaaggggtatgccagagacagctaaccatccatcaacatccattttcccctctgttatacacaattacaaatgagaatgtgacacttatcaacatttcttcaacacttctcagcctctcttgtagcgaggtgcatgaggctctccctagattttaagacaggaatcttaaatattttattttctataagaggacagacagtaaacactttgggctttgtgggccatatggttctctgttgcaacttctcaactctgccactgtagagagaaggcagccacagacaagaccaaaacaaatgagtgtggctgtgttccaataaaacttaacttacgcaacaggtggtgggccggatttggcttgtgggctatcatttgccagtccctggtttaacagatgctcagcctaccaaatatagtattagtcttccaggaagagtcatctgattagacattttgtcctgtgtgacctcgtaagccaccaattcttattttacacacacacacacacacacacacactctctctctctctatttataattggtctgtgtctctgaaattctcatcatgttctgaaacgtcaactgtttcctgatctttaatcccagtctccatgggccatgtccctctccctttcctcctcctttttaggaccaactccataatttgcagggctcactacagatgaaaatgcaaggccccttgttcaaaaaatattaagagtgtcaagacggtgaaagcaaagcataaaatctaacatggggctttctgagcatgagctcaggttacaaagtccaccaagcagaccctgctggtctggcttgtattaccatcagcaaacccagaaagttttctgcctaatttcttgacaagtccagaaacttgccacctgcgagctgcttgaagcgtttcaggaatggttttgcacatcacaagaagaaggaggaaaaaaaaaaaacccaattttcttttagtatattacttgttagacagcgaaatggaatataattatggtgtgacatttccaacagcaaatatgttccagtgtaagcaattaacaccggttcttttggcaggcttaaaaagattactcagagactgtggtaagttacaatgccccatgaatcataaataatgtagaatcgcagctaagttgcattctacgaccaaagttcaaatttcttgatgaaaataaattgggtgcttttaaccctctgttgacttcatgtggcttaagcagattcggatcataagttctttggatttttgtaaattacatatttaccttacccctaagaacatctgcaaaaaattataaaaaaaaatctgcatgtattcatttcagctgctggaaatttgcatgaggtagtgggtttgaaggggacccctccaggatggacagaatgggggagacggcttacactgagaactattatccttggaggctgttatggttaaatgatgaagtcccaagatttagtagaaggcatatctggacctatgtccctattctctctgccattcttgacacaaccaaagggaaggcagcaccttctgaatgtatttgtgcagcttgtgactctgagcaactgaaaccaatgaaacaccagcagcagttacagagccacataccgtagggacattcaaggccaccgttacattcaaagcctcagggccgtagtacccttgtactatagcactactagcactatgggctggataactctctattggaggtgacagcaagctgtcctgtgcattgtgcagtgcccaggagcatctctggactcgatccactaaatgccaggagcatcctttctttagttgtgaccattaaaaatgtttccagcaggcacagtggctcacacctgtaatcccagcactttgggaggctgaggcgggcagatcacctgaggtcaggtgtttgagacaagcctggccaacgtggcgaaaccctgtctctactaaaatacaaaaattagccaggtgtggtggtggtggtagtgccagctactcaggaggctgaggtgggaggatggcttgagcccaggaggcagagattgcagtgagccgagatcacaccactgtactccagcctggatgacagagtgaaaccctgtctcaaaaaataaaaacgaagtttccagatattgccaaatgtccctggaaaaaaaaatactactttagatagacctgggtccatcactgtgtggccttgagcaaatgacttcattgctttgagcctcagtttccacatgtgcaaaaaaactcccatgcctaccttacagagagattgtgaggctgggatacaatgatgcagatagagcgcttagcctggtgtctggcataaagcaagcattcagtaagacagatgctatttattccatcacccatttgattgtttacaaacagctcctgagcacagtggagccatggcaggtaccaggggtgtgaagacgcataagccttatctctgtctcagacatgctaaccaacaacgtcagtgcaagggggtgctccctaaaatgaacacctggtcatggggcaatgggggcttggagaaaaatacctaaatctcgagacttcatggacaggatggcacctgagtaaagtaaaagttttccaggcagacacacttggggaagggcattccacacagaggcaactgcatgtgcaaaggtatggtggtatgagtcactcagaactcccctgagctcaggacggctgggaggtgaattctacaatgcaggtaagggaggaggagcagcaggaacaaggctggcaggcagagggcagatgaggaaggatcctgagatgtcaaatagttctcatctctcttgtcaacccaatgaactcatagcaaagctgagtccaaatcctgccttgcaggacgcaatgcagtgattgattagcaatgtctgctttggcccaggaaggtagaagaggctcaagctgcaatgtatttccttgtttgatgagggttttcatcaggggagtgatgtgaggagaagcacattttttaaagctcactctggaagccatgtttttttgtttttgtttttgaagagaagacagaggcagaaatggagcaggagaaagagttgggaagtgactgtaatactaccagacagagacaatacatgcctaaagggcagagcaggaggctggggaggaggagacagatacaaggtatttaggacctagaaatgatagcgactttgtggatttaagggagtagaaataacagagactcttggatttttggtttgggcaacttggggaataacagggttattcacctaggaaaaaagttcaggagattttggaggcagaaggatggtaggttatttttcagacccttagctcgtggaaccccaaggtagaaatgtccattgactgttgtaggtttggatcaggaacccagaccagtgatgaggaatagagtcattgcttagatatggcggctgtcttcactggccaataagtgagctacagtgaccctgcttctccagcccctggggaagcccaactgtaaatgagaaagacagctccttccagtgggattctttcctaatctaaaggcattcccgattgacaggattagtgaaggacgacagaagaaagtcattactgaataatcccctgcacatttcatagtcaacacagcattcatatgatccttgtaatccaattaggtgatgcaggaagctatatcttaattcctgacttcattgtgacttgcctggtcacaggcaaaccttgtttaataaggtgtcacctaaacactgagtggtgcatacaaaatgggcacagaacggtgatggggttgggggctgaggggaggaggtgactgctgttgagaatatgtcctgtctcaagcagccaataggggacttagaagctccatgtcctcatcagcgaggcttgtgattggaggaggcttgtgattggaggaggcttctgatcggtggaggcttgtgattggagaaggcttctgattggaggcagcttcatctccccttctctccatccattttgctcctccggacctgtgtgtgacaactgtctgtctggtggctggaactcatctgacaataggaacaacaatcatttttacatgattgctacttactgagggcccacttcatacctggcattttacacacctggcccaaaacacccttgggcagagtagattgtatcctcattctaaggatgagaaaactgtgactcagagagattaaggcatttgtctcaggccacacagctagagttacagctgggattcaaatccagatctgtttgatttccttttatttttattttttgagacacagtctcactcttttgcccaggctggagtgcagtggcacaatctcggctcactgcagcctccacctcccaggctcaagcaattctcctgcctcagcctcccaagtagctgggattaccaatgagtgccaccaagcccggctaatttttgtattttttgtacagatctgtttggtttctcaagttagtgtcattcgcctctggcaccatgcccttctgaggtgagattccagaactgacgtgcaaaaaatgtgcaaaaggcctcctgaactgtagcccgggccagtcctggcccgcatgtccatgtgagggctggtttgcctccatcctccttgtgcatgtgaccccagctgtgggcttatgtggaccggatgaatgtgactgtagttacacctagatcacaaacaacatctgagaggaggtgatgcctctgatctctatcagaccacgaggaaactagagagtatggagtctactccaagtgctgggctaggccccagccttatggcttatgctgggatctcaaattccaggccacactgggctacccatgtaaggtcaatgagagaagtaggccaggtgggggcagaggcaaattagaacaagcccattcaccctaacagaggtgatccattctcagcgccaatcattttaccatggggaatgcattccaagttgctcagtcttctggttttccagaagactccagaaatacttattcttatgggcattatcccaattttaaaatggttacaaattcacatttgtaaaaaaataagctgtatgtgagtgtactgggttaaacggcatccctccaaaatcatgtccactcagaatctcagaatgtgatcttatttagaaatacagtctctgcagatataattagttaaattaagatgagttcatactgggttagaatgggctagaaatccaatgactcatcttctcctaaggccatgtgaagacatgcaggaaggtcacgtgctgatagaggcagggactgcactggtgcatctacaagccaagaaacaccaaggaacgccagcagcaactggaacctaggagagagccatggatgcttctccagatcctctagaaccaaccaaccctgctcatgccttgagtgtggacttctgacctccagaactctcattctccaggacgagagaataaattcatgttgttttaagccacgctggttgaagcgatttgttatggtggccgtagggaactaaaacaaagagccaaacccaccagggctgcgagaggaatgtgcccaactgtccttcccatgatcacaggatcatgctcttgatcctgtccctgtccacctcctcgtctgaagcttgactgattcactttctcccttgcattgctgcctgtccactatgctggcctccatccttcctgggctagttccgatgtccccattttaacagcatttcctgatattggccactctaagccttccgtgagcagtagatggtcctgctctgcaccctgaaatctgcctgctgtctgtcagtcaactggagttgttttccaaaggaagctgatgagaaaatccaaaggcttgtcttcatccattctccgtttttcttccagagcttccaacagctggaggccgcctcctctttttggaataccctgctcttttggcagccctggtcctgcccttccaaggtcatctgagcacctttcatcacttcccttggctccgtgatagccttttctttcatcctccggtcccttcaatgtaggcatttcaggcctattctcttctctatgctttaaataagctaactcagtggccctcaactggaagtgatatagccccctagatacatctatcaatatctggagacatttttcattgccacaactgggtgaccctgtactaccggcacctagtaagtcgaggccaaaggcatccaaggggcacaggatagcacctgacaataaagaatgatccagcccaaagtgtcaacaggaccacagttgaaaaaccctgagctaacagaatcccactttgatgctcttgatcatttatctcatgacttgtgcctctcaaggaactctagtcttgaatgtgttcagaaggaaacagttcacgcattgcttcttggagatttccaatgtgcatttgcccttgaaaggctctgacaaggtctgcagccaaataaaaacttgctttgcatttgtttaatccaccatttcctaatgtatttgaatacagaaatcctttgtttaggcaataatcactatcattcttctgaagtaagctgcagtatctaacaatttattgagcatttaccatgttctagagtgtcctaagcacttcacacatcctacagggcctttctccccacaggcagtggggggcagtggggtgcagtggataacagtgttggctctggagtcaggtagctggcttggaatttgcagccacatcagttgagctgtgtgaccttcataaatgccttcatttctctaagcctcaatttccttacctttaagtgagggtacagccatgcatcacaacgatgggatacattccgaggagtggattgttatgagattttgttgctgtgagactatcacagagcgcagttacacaaacctacatggggtggcttagcacatacctaggttatatgctcctaggctacaaacctggacagcatcatactgtactcaatactgtaggcaactttaacacaattttaagtatttgtgcatctaagcatatctaaacatagaaaaggtacagtaacaatatggtataaaagataaaaatggtacacctatataagatacttatcatgaatggagcttgcagaactggtagttgctctgggtgagtcagtaagtcgtgggtgaatatgaaggtgtaggacattactgtacattactgtagactttataaacactgtacacttaggccacactcaatttataaaaaaataaactatgatgttatgactacaatgtaactagtccataggaatttttcagcccctataatagggctgaatagtcaacgatggactgcacatacaatggtggtcccgtaagatattataatcttattataataatctattattatatataatcgataattatatatattataatatataatagataatagattataatcgattatatataatatattatacaatatatactatatataaaatatataatatatattatatatacaccttcatatttgattatatgtaatatattatatataattattattataatctattataataagattataatatctatatctataatagatattatactcttatgggaccaccattgtatatgcagtccaccgttgactgaaacactgaaacatacagtgcatgactgtgtctgtgtgtctgtgtctgtgtgtgtgtgtgtgtgtgtgtgtatatatatatatatatatacatatatatatatatattgcccatgtcaaaaagttctgaatctcaaattagataaaacttgcaaagggctttatggtatgttctcagtaatgttgattattgattgattgatgatgatgaagatggcggtggtgttggcagtgatggtggtggaggtgatggtgatagctgtgatgactgtgaaggcgatgacagtggtggtgatggggataacaggatggtggtgaaagagataataaggtggtggtgatggtgattctgatgggggcggcagtggtagaggtgatagtggtgttggcaatggtggtagtgatgaagatggtgatgatatgaggtggcggccttcgtcatggtgttggtgataatgttggcagcggtggtgatggtggtattgtactctctatttggactgtccttcttgacctggtgaaattatatactcgcctacttatttatctcaaagactacgacgttttcactgattgccccctttgggcataattcttcctcttttgtgtcatatttttttaatgcctccaccatatcactctctgacatacactatcaggacttgtctcctctgctcttcagggggcaccttcccttcacctgccacatacaaagaggggccgtttaataaatgcatgttgacatcaaatagggtggattatggggcaccagaaccttccaacaagcctctccccaactccacaggaaaaatgacaacagaaagcaactcgatgagaattttgcatcccctgccggcttcaaggagacctcaaggcaaactcatgcccagcctcaaaacactcagaaaatgggaggtggcaccagaagacaagtttcattgcaggccaggcactgcccatcctgcttgaaaacagtgagtgatggatgccagtgctgagcaaagcaaaaggagggcctggaaaggaagcagcctggtttcccgctgcaagctagtgatggagacttctgactgcggaagcgagcaagagtcctcagagcagaaatttaagtaggaaggtgtggtgcagggctctgcgcatactaagcggcctgcagacgcgccctgcttcaaagcagagattgcaggctgccagctcctgggcctgcccagcctgcagacagcttttcttgggctcacactctgttgtgctgctttgttttaaattaaaatagttgtcagttaaatcaagagatttcagattaaaactcagatttcttacaaaaagaataataattggaagagtgagcaagcaagcctgggcctgcagttctcaaggcaagggagcctggggctttacactatcgtggagctaagtgagtggcagcttctacctgcctactccaggcattgacatcctgcctggccccttggggtattttgtgacgcttgctataaataccaccagtgtatgaaatgccaacttcatcctggttaagcgcacgtgcttgggggtgcggcagacttggcttcacatcttggctctgattttgcgtagctgggtgatttcaggcaaggttacttgctctccctaagtcctagtttcctcatgggccaagcaaaggatgctaatgacatggctcctccatactgaaggattcaagaagaccggacctaagacacacttatggagtgattctcataactggtacctgtgtcaacagtgaggcgggtactgctgccacgcccattttgcagaggaaaaaccttagactggagggatgaagtgatttgcccaagaatgcctagcttgtgagtgacagagcctggattcaattgcagaaagcctgccttctgcacccaagtcatcaccacttccaactctagatgtttcactcccaagtggcaaaatcatccctccatttcagctcttgcaaatctctgggcctacctttatccccgcttaactgttcagttacatctttgcctttccgatgaggctctgatcaacgctaagtcttgagatactaagttctgcacagctatcacccgtttgcctaatgaataatgaataaatacctaataaataaataatgggtaaataagcacataagaaatcaatcaaatcagctagtgggtagagagtagataaaaacaacaacaaaaaactaacagctcattgactactctttttttttttttggcatttctaaaatctctctgggatcattatacatttcacagcagcactcgaagaaccctccccatgtgggaatccagcaaactgagccatgtgataaaataaataaataaataaataaataaaccatcttctctgcaaccctaaggttcaagtctaccctgagcaaagtgaacccagcattccttggtgcacatccacagtaaatgattacttagcccacagagaaatgtctgtctgcaagactgtgttagttattatcctatcataataaaacagattatgctatagtaatgaatacgaccataatggtctgcggcagtttaatcaatgcattcttcaactgcaactgagcaaaataggtaatggaggatcatttgatctacatttttattaatttggtgtcatctgtctcctggttattttaatcatctctcattatgagaaaatgggaaaacttcctgaaaaaaaaaaaagtagagtcatcttgctctattttattcctcgctttgttttagtgtgaaaagtagcttgttccagttcagtttgggaatggaggttactgatgcctgattaaatgtagttctagatttcagagggaaaagctcccttatctcacacaagtcagacaaagctgttcaagtcatacacaagttgagacgtgttgaaagtggcctggaaccactaacagccaaatcatcatcattatcatcttttttttttttttttggagacctactatgtgctgaatgtgctgagcatggtgctgggtgagctcttctctccagtcctcccacccatcctgcaaaaggacgtaccagtatccccatttacaaatggggttcagagaggtcagctaacctggccaaaggtcacacagctggaaagaggcagtggcagactccaaactcgaagggccccgtctcaatgcctctcagtatttcttgtatgcacgaaagggactgtttgtttctcagtccccaaagacgcgctgagtcacggtagaaattatgcattcaggatactgagtggggaattatgacaaatgctttctttgcagttcctttaaggactgtgtctctcttgatatagctttctggcttaaaaaacgtttgcctagtgcctgcatctgtttacagaaaatctgacgtgttggtaaatttgcaccttgagtgtcctccaagtaacagctttagtccaaacccaggttctaagggcaaccatccctagccttttaatcacatacatcactctctattacttaatcattgttattattattattattgagacagagtcttgctctgtagctcaggctggggtgcagtggcccaactgctgctcattgcaacttctatctcccgggttcaagcaattctcctgcctcagcctcccgagtagctgggactacaggagtgcgccaccacacccagctaatttttgtatttttagtagagacggggtttcaccatattggtcaggctggtctggagatgcctttttcatcaacagatcagcatggccatgtgtggccctgaaggcttaaggttgctagatctttccatttatcttgagggaagctggagatcttgaaatttaaatacaagcatctgatttttaattattagcaactaattcagaaaattcaagcatctagcctgggcctggcatcttgctggctttagtctccatgctaagagtgaaagtgagcatgtgtagggtcttaccacctcttcttcctttacgagtctaaatggctatcaggaatcaaagacacatggactttttgttagagggactaaggagtgtcagtatcacaactgaaatggagagtacaaaaaaaaaaaaaaggctggacttggttgaggggacagtgtggaaaaactgatgtgggactgtgacctcagtgggacatcggactggtgatgcccattgtagtttcccggggctgccctaacaaagtcacacagctggggggcttaaacagcagaaacttactgtctcatagtgccggaggctggaggtccaagatccaggcgttggcagggttcgtttcttctgagggctgagaaggaagaatctattccatgcctttcttctggctcctagggaattgccggtaattcatgttccttggccttgagatgcatcacctgtctttacgtccatgttcccttggcattcttctagtgtgcatgtctatctgtgggtctgaacgtcctctttttatacggacacagtcatgttggattagggcacgctctaatgacctcactttaacttgataatttgcaaagaccctatttccaaataaggccacattcacaagtcctggggcttaggaattcaacctattttgggggatacaatgtaatccataatatctacttagcaattgagtataggattctgaaattctgaagagaggcttgatttaggtataattggcatttaggtggctgttcaacgcagaaagtaacgtaaagaacaatgttcaggtgagtcttgtttggggatttaaaagatgaaagattctaaggatgtgtaatatacgaagtttggtgcttctcaaactttaatgtccataaagtagaaatactggtattcaacttacaatcccaattattacattattattatttgaagggctccagaaggagatctgtgtttttcagtattttttccccattctcattccaggaagaagttccaaaatacattagagaaactattaatttttttttccaaatggacttttctcaccccacaagttggcctcccttggggtgactcctgccctctcctctgccttcccacactcagcaatgtgtcttggttgaagatactggttggaggtttaagatcaatgcccttcgtcctgacaggcagtgaactggtttttcagaacctttctcatgactccaggaagtgcacatgtaattaaactgagtctgtgttgggtttcagattagtgaagtgtgcctgtggcaaaaggtctcttccttcctgagagacgcagcggtgtaattagaatccggagacggattcatcagcatttcttaccagcgtttctacaggatgctccaatattcatctgggcctagttctgcttcctgggagaccatgggatgttgttgctggatgccatctgctggcaaaatgcaggggttcctctcgggtcacttgggtgacactgggggttcagtccattccaagcaagttagctgagagcccaggtaaaagtcagtagcaggctggtaagtgtctgtccttatttccaagtcagtattaaaatggtccaggcgtaaggctggctccaaatccctctgaaggtcattgttcatgcattagcagttcagcaaacatttgtagagcatctggtacatgtcaggccattccaccttcacttagcatcctttcggtgagggcagtggtacctggcacacaggctgggggatttttatcatgagctgaagtcagagcactttttcccctggcctttccattcatccaccccatccctaaaagtcaactgaaaccctggagaaacaagttgcagttattccttgttaaatctgtaatttattcccattaatcctttttgaagacaatggcaaatctgtaaaatgttcaaatacacacaggaaatagcaggccggaattttcagcttttgtcttagaacaggagtcagcagacttcttctgtaaagagttagactgtaaatattaggttggtgcaaaagtaattacggtttttgctattgaaagtgatggccaaaagtgcaactacttttgcaccaacctaatagtttaggcttttggagctgcacagtttctgttgcaaccactcagctctgcccttgaggttggaaagtagccacagatgatgcataaatgaatgggcgtggtagtgtttttacaaaagcagactggcagctgtctttggacccaggacccctgtcttagagaaatcaggttttgtgatgctgtcggaccccaataagggaaaactctaaattccctttcatggcctacaaggtcctgcatgaccagatccctgccctcctctttgtcttcagcatctatgcttcttattgctaattaaacttcagctatcccttccgccttctggctcttagtcatgccaagtgtgtggcaactttaggacttttgcaaagctgttctttcagtttcaacggcaccagtggagctggactccatccttttcagtttctcccacttctatcaacttttccaaataagtcgaggagtttacgtgatctcacaatggggtgagatatctcatgatatgaggtagggcagtcatctgctcattttctagatgcagtaatttctccatttcagtcagtgatagcaacaccaatcaggtcctctaatgaacaatccaggtgtcttcttcgattcctccccagcctcatctctacagccaacagactgccaaattctgccaaatttgcctcctgaattgttttcaaatccaacttttcctctttcttaattgaacctattgtcatttcttgcctagactaccccaaaggcatgcttactggactcttcacttgcagacttggacccctgtaattcatccatccatccatccattcatccatccatccattcatctcattcatccatccactcacccacccagtccatccatccatgatccatccatccatccactcatccagtccattcatccatccatccatccatcatccatccatccactcacccagtccatctatccatccattcatcccattcatccatccactcacccacccagtccatccatccatgatccatccatccatctactcatccagtccattcatccatccatccatccatcatccatccatccacccacccagtccatctattcatccatccatccatccatccatccatccatcccattcatccatccactcatccacccagtccatccatccatccactcacctagtccgtccatccatccatccatccatccatgcatcccattcatccatccactcatccgcccagcccatccatccatgttcctagtccattcatccattcatccatccacccatccatccatccacccaccgagtctgtctgtccttccatccatccacccacccagcctgtccatccatccatccaccaaccacccactcgctcagccagtccattcatccatcctttcatctgtctgtccaattcacttatctttttatccatccattaattgactcatcccatccatgttttcatccactcaacccatctttccatatatccacccatcttctcattcatccctccatttatccatccagtgtatctacttagtaccaggtggtgtaagtagtgaaaaaaaatatttagaacctgccctcctggatcttttagtttaatttggaaaagggatgctaaacaaactacacaaatacatgcatattaataaactggaataaatgctataaaagaaaagttttgcctgagaaagcataactgggtttaaactcagatccaaggaactgcatgaattgctgggagaggcatgagaacaggggtatggacaggaagactagcatgtggggaagccttcagctacagtctgctttctctaggggatgcaggaacagggagaatgggtgagaataaagggagataaggttgaagaaggaggtaggccagactgcagtgagtcctgaaggtctcactgacttgcaatggggaaagtccttggcaagtcttcagcagacgagccacacagttccaagtacatcttaagaagcacactctagatgcagaatgaagattcacttgggagaggcagggagcgggtatgagacgcagatgtgagcaggtaagttaggaatgtattgccacaatctacatgacagggatgttgcagaagagacagagagagaaatggacccagcagtgatattcaggatgtagaattggaaggtcttgctgctggttgaaatgtgagaatgagaactaacctttttcaagctcttcgggaccaagcctgaaccagcctcagtggcctgagctttccagaaggaaataatgctttctttaatgatgaggatagtaataagataattagcactgaacaagcacctactctacaagcaccaggtactttattatgtattacacatcattccatttaggagaacctgttggatagatactatcattagccccattttagagacggggaaaaatgaggcacacagaggtttaggtgatgtgctcaatgttccatagctgttggtagacccaggattcaactctagaaccccaatgattagaagcccatgtccttgaccatctggacaggaccatttccagtattccacatttcacaggatcctattccatgtttttggagccagagaactccggcgtagacacccctctgccaccccggagagaaacctcataggattccagacgcataagtaaagtctggaggctgagctccgctgatctgctgcagtctttattgctctacaaatgcattattaatcagccactggggtcctccccatagagccttttaaattacagttaaattccttgatagcgtttcatgcacctaatggtgcagttcctgtgttcacggcaataaacaaggggagagagggaggcctggataaccaggttaattgctctttgaggtttaggctgagaaagcaatggcaacagcacctctaaattctccaggtccctcactgcaatgctaataaagtcttgaaacaaacagcgctgtcaagccagcatcaggagtagagactacagtttcttcatgcctggcccactgccgtggcttcgctgggcctccaggtcaccttgccagggccctccttcttgggagctttcagtgtgagtgcgtgagtgcatggagatttggtttttaatggccataaaatttcagttttgcaaaacgaaaaagttctggagatgggttgcacaatcaatgcaacaatgaggagagggaggacaagaggcagcattgacgttggaactgatggggcacccctgggaacttgctgcttccttacgagtctcttactcccaggttatgaaacggttgacttttaggggatacagtgtggggaagaggcagttaactagcctatcttctggaactgtcttctccacatgctggagttggaaggtgatagcagccagggagctctccaaagcaggagtattagtctttcacactgttgatagagtcatacccgagactgggtaatttacaaagaaaaagaggtttaatggactcacagttccatgtggcggggaagacctcacaagtatggtagaaggtgaaaggcacgtcctacatggccgcaggcaagagataacttcagctggggaactcctctttataaaaccatcagatctcctgggacttattcaccatcataagaacagcaaaagaaagacccacccccgtgattcaattacctcccactaggtccctcccatgacacatgggaattgtgggagtacaattcaagatgagatttgggtggggacacagccaaaccatatgagcaggggttggcgaattatggtcttgggccaaacccagccatccattttgtaaacaacattttatcagagcacagacatgcctattcatttatgcactatctacacattgagttgagtagttaggacagagaccttctactctgcaaaacctgaactatttattatctagccttttacagaaagtttgtcaatccctatgttaaagtgtaaatcagattgtgctaccgtcttgctcaagacccatccagggctccctacgaccctagagtaaaggtcaaatgacttatctggaacaaatcatctagcctcactctgcaggagaattgtcatctgtgaaatgggagaatgaagaagcctacttcaccaatttagagcaagatttaaatgaggcaatgcatgtttcagaagagctatttttaaaaaatggtaaaacacacaacataaaatttaccgtcttaatcattttaagtgcacaatagtgttaagtatattcatattgttgtgcaaccaatctccacaactttttcattttgcagaattgaaattctacggccattaaaaaacaaatccctgtttctctctccctcaagcccctaggtctcaccatcctactcctgtctctaggaatttaattactctagataccttgtgtaagggggaatcacacagtatctgatctatggtgactggcttatttcacttagcgtgaagtcccccaggtgcatccatgttgcagcatgcgatagggtcttctccctttttaaggctggctagtattccactgtatgtgtagaccacattttgtttatcctttcatctgttcatggacacctgtgttgcctccaccttttgactactctgaataatgctcctataaacaaaggtgtacaaatgtctctttaagactctgccttcaattcttctaggtacacacccagaagagctaacttttattgagcactttctagagacagcctctgctttaataattcacacagatcctctcattctatcctcacaacagccctacaaggtgagaactattaagactatcatcattagggtgaccagataacttattatggtcagtttatgaaaagcctgccaatccctttgttaaagtctaaatgagatcacagcactgtcttgctcaaaacccatgcatggctccctaaaggtcaaacgaattatctgaaacaaatcatccagtctcactctataggagaatcctcatcaggttagagtgagactggagaactcttgagaggaaaaaggggctccattactaactataccaggatgacaggcacagatcgggattgtcctgggcaaaccagataccaatcatcatccccattctatagattaaagatcaagcaacagagcagtgaagtcccttgcacaaggtcccgagtgagggaggggcacagctaaaattcaaacccaagccgaccgactcaagctttcactgctaagcacagttctatgtgcttagcacaaggagcggcaacggtcagcaatcaatgtgaggtgtctcattatggactcttcaggctggggagaggggtcttcaggacgcaaagggtcatcaagggctgagaaagtcagaggggtgagggggaggcttttcacacccaggagtgagactgtggatgccaatgtgtccataccaaatgtgaacttgccccatggagagaagcagatgcccaggtctcccaccatgcttggccacggcaccatggacattttggactggaaaatcattgtggggatgtcctgtgcattgcaggatgctgagcagtatccttcgtgtctacgctttagatgccagtagtaccccctttcccagtcgagacaaccaaatgtctctaggcatgtccagacgtcccgaggggctcagtagcattggttgcaaaccactgaatcagggaaagggcagaactagggggaacaggatgttctcccaggtccgggcttctcaaagtgtagttctggagggcagcagcctctggcagaagtgtgatttctcaggttctgtcctcgacctgggtcagaatccctgggggtggggccttggggggtctgttgccaacacaagcccaagtgtggccggcaagcactgtccttgaccacgcaagaaaattgctgggatctcggaggactaggcacgagagatgttactaacgtgaaacctgaagagggatcccaggcagaatgcaggatggaagatgaggatgttttagaggctgtcaaggtcctgttggtgaccaatacaggatatactgttataaccaatacaggcttttcacagggcagtttgatgctgtctatcacaatttaaaatgggcaagctgtttgacctgccaattctattcttcagatgctctgtagcagccagtctcaactcaggatccccaagagaattaagctcgaatgtcctggggcatccgttgtaggtagcaaattagcttttctctgatgtatccagaatggtactagttatgtacatctttgagagatctgagaaaacagtcacttagtatagtaaaaaactggcaacaacctaaatgtccctcaataggggaatgaccaattacactgtggtgtatccatacccagagttatatggtcagctactataaagaaataacttaggtctctagctccaggcaaggaaacagacctcagacctggacatgtgcaacaacaacaaaaaaatcatctaacttgtgaattctttcatcccacagccagatactattaatatattttttacaagtttcagatttatacatcagtttcatatgatttatgaatctcttgtcacaaaaccacactcttttttttgacatgtgttgagtttagatatctaaagaaaaacaaaaatgtacacacaagtgccactgctcagatgggactgacggatcagggtggattttccccttatctgcaatgtttcagtattttaaaataatgagaatgtatacagccttgacttgaggaattagattttaacaagcatcctttctgcattatttgggcaagttcttaaaaatcgtgaggagaattctcctttccctgccttctcaccatcttttcactttggtcgctgcaaatatcaccggggactggctcttggcagcctcccagttcctctgaaaggtttctcactctatccatgccacacttggaggtgagctattaatttgcgctttgtggctcagctcgattctgatttagggcaacataaaccctcctcaaaattgcgaagaataaattagtttactaatttcgccattaagagtttatcaaagcaagcactatttcaatcgtctcttaatcaatcaccattttccgtgtttatctcctgttcaatttttaccagagggttctatacacatcaatttgtctgatgttcttcctacatatgttttaaattactttatcattgtataaatttcacagccattaaaaggctctaacaccagaatgactgacatggtgttaaaaattgaattcaattccacggggtaataaattgtgacctaaatccaatctctcatgggtgactgaaggatacaatgaaaaattattgctttgtcatttttacactaacacaaatataccacagcaactagaaactggcagagaaatgggaggtaaccgcggctggctatttctcaccccaggcaatgaactgacttcaaacacaagtccttagcgtcttggatgggattggcgcccccgcctccaaaagcaggtgaattatctgactgtgtgggtgggtctcattgcaacagacagattgagcacaaggagcaaatgtaagctgcaaagggcttgcttcagcctgaatgcagctgctcctatagacaccaaagtgcagtggttaagccccttgccacgccactggaaccaaagtctctgagctcagagcctggctctgctactggtgaaatgtgtaattctgggtaagttttctgtgtctcaacttctttgaatacaaagttgttatgaggaataaatgagttaatgtggctaaaccttcttaggatagcccttggcatttaacaatccctacgtagaggttaagtgttattatttaagagcagtttcttgtatagagaccttagctccctgttctttctggctgcagagatggagagtaacaagtatcaatagctagagaaaggtgttgattaacatgcagtgcattttcctttatctctggagaagctagatcagtcatttaacacatctggttccacatttactaagggtaccacagagcagacaagttaaggtgtgggttttgaagttaggcagaagtgggtttgagtctaaggtctgtcacttgcaaatgtgaccctgggcaagctacttaacctctctgaggatcagtttcttcgtctgttcaatggaactagagaacatcccttctccagggctgtgcaggagtcgcgatgagatcacacatgcaaagtgctcgcctccacacctggcattcaggaagtgcctaagaaatgtgggttctcgtgtcctagccccgtgcaggcaggggctggagatccagtggtggagactcaggatatgctatagcagccagtctcacctaagggtccccaacagaattaagggtactcagcccttgtggctcagtgtgggctacagagcactccagcaaccacgctatcctgtgacatgtaccccagcagggaacaggcaaggtggtttgggggcacacagcttgagcacctcacacagacttggagaggtgcagtgtggggagacagcatcacagaaggcttccaggaggaagtggcattgatatgaattcctagccctggactgccaagtaatttgagagaggagaaaaggccagctagttttgttgacttatgcagaaaggagagatagctagtcttttcactctagggcttatttcattcattcattcatttattcattcactcattcactcattcattcattcaagggccatgtctgggctccttccttcttgcactaagtctctgtcttggggaccctgggtggcagacacacaatcagttgtgcccaagggagcaagcctctcatggagcaagaattctatgtgctcttcgaatctccattctctgccttgttctggggcagctactgggcaagaactcatggaacgccaagaaaatcatcacaaaccaccctgccatggaagcgagtctcccatgcccacctgcaggcttccagaaccacaagagctgccaatcgagaggtggcctatggctgacttgtaacaggtgcttggtaaatatttgctggctagaccgatggattaatgaaagtacactcaaatacggtattttattcagcaacctgaggaggcaggggaggcccttgtgcaatctgttttataggaaagacgtgaggctcagagaacacaagtgccttgttcaaggctttcgcagccgataaagtggcagaggggccgcaagtcttttgagtttggttcaaaggcttctcctaatccagggtcaggtcaatgatagtgaaacagcccaggacactgagtctatgacattgctggaggcactgaggatttccttccatggcttggatgtcatgagaaacagcactgtaagaggaggaaagacctcccaaagatgtgtaccctaaatccagggctaagaacttgggggcaggggttgctttcctgatccaagatgacctcttgttcagggctcaaaagtggaagaagcatgattctgtagagagaggatgtgagacctgccccccagtcccagcctgccagacccttacctttggggctgatatagtttggctgtgtccccacccaaatcttaaattgtagctcccataattcccatgtgtcatgggaggaacctggtgggaggtaactgaatcatgggggtgagtttttcccttgctgttctcgtgatagtgaataagtctcatgagatcagatggttttataaagaggaatctccctgcacaagctctttctcttgcctgccacactataagatgtcttttgccttccgccatgattttgaggcctcctcggccacatggaactgtgagtccattaaacctatttttctttataaattacccagtctcaagtaagtctttatcagcagcatgagaacagactaatacaggggggcctaccttcccctcaggtctctggcaatttcagttcagtactgagagatgcctctacctccattctccttgctcaaagcaaagacacagatcctctaaacctagcacttttaggaattacaacttggcctacgagcagattaacctttttgcttataggaagagctcccctgttggtcttgtgagtgttttaaactatcaacacctctgcctacccgagggcctttgcacacgatactcccttgacctggaatgtccccctccagcttttcctctagttaactttcaccacccttcatctcttagctcaactataaaacacaactatgcaactccccagaattgctgttgcaattttacatgtgaattttttttttttttttttttgagatggagtctcgctctgtcatccaggctggagtgcaatggtgcaatctcagctcactgcaacctcctcctcccgggctaaagcaattctcatgccttagcctcctgagtagctggcacccaggtaatttttgtatttttaggagagatggggtttcactatgttggctaggctggtatcaaactcctgacctcaagcgatccacctgcctcccaaagtgctgttattacaggcatgagccaccgcacctggcctacgtgcacattttaatgatcgtttacccctgtgtttccctacccaactttaacaggccacaagctccctgaggacggggattctatctgctttcctcccaaatgaatccatccaaactagttcctggcatagacaggggatgctcgatgactaattgttgaatgagggtatattgaagggagctggtgacaaacagtttcaggtcccaggtggtggatgccatgctcagaataccacctccacagagattctagatgcccatttccattgctttgcttggtgcacacaggcctctgtagagaccccagtgtgaagggaggttgagccactgaggctaaaagcaaccacgttatcttctttcccagtgagggcaagactgaggattatgatgtgccaagcacgagatattcaaagatgagtacgatcaggcccctggcaagtctttccccaccatctaaaccaatgtcaggcacaaagcagcctctcaataaatattaaatgaataaaggaattcagcatatccaaagactaggaactgttccatttgcaagcagcttaattcttagcaagttcttccacaatgagaccaaatctatttctgttccttctctaggcacctatgtagtttttttgtttgtttgtttgtttgtttgtttgtttgttttgagataaagtcttgctgtgccacccaggttggagtgcagtggtgtgatctcagctcactgcaaccttgacctcccgggttgaagcaattctcatgcctcagcctcttgagtagccgggattacagacatgtgccaccacacctggctaacttttgttttgttttgttttagtagagatggtgtttctccatggtggccaggctggtctcaaactcctggcatcaagcaatgcacccaccttggcctcccaaagtgctgagatcacaggcgtgagccaccacacacagcctgtaggcacctatctaaatggttccccacctcacctgtcctctcatcctgctcaacgtcttcaaataaatcatagagtcatatccagacattagattgcagatgtggctattcacttgtcacctctggtctctcctattcaggtagaagctccatgagggtacagccatctagacgcccaattgatttccagaaccaatggacatggtactcaagtggcacaaggtgttctctgctcttgttcacagctctaactccaggtcctagaacaaggattggcaaaccacagcctgtaactatctattttggcatggcccttgagctaagaatgggttgacatcttaagtgggtagaaaacaaatcagaagtagaacagcatttcacaacaagtgaaaattatgtgaaactcacatttcggtgaccataaatgacttgaactgaagcatgcccacaatggtcatttgttgatgtgttgtttatggcagctttcacgctacaatggtaaagttgaatagctgagacagagaccatgcattttacaaagtcccaaatatttatgatctggccctttatagaaactgtgtgtgtgaggccctgtcctggagcacagccttgaatgtggtggctgaccaatgaatgggtcttctgatgttctctggatttgccagtctcttgcctttccccagcaagcccaaggaagacctttgggactagttttgtccaactccaatgaactgttactggatacctcttccttcctgggctcctcagaaggagatgccaaagggcccagttggaactgcaagggccgccttgggaaagcccgtcaaccccacccacttagccaagctgttcctggtcaatgtggcttcatcacatcaccctcattagcgtggtaccttttaacttttcacagctattccctcattttctcatcattggtgatacagcaaaggatctgggagaaagtagtatctctggctgacaaatggggaaactgaggtatttacctgggaccacttgtgacatccccagttctattttccctccactgcggctgtcagctacgctttctagaagccggctactcacgctgtgtagttaccccactgcccccagggcaggagggatgtagaagagactgcccttaagcagctggcagtatcatctgccagtctctctctgcagcgagcggccagccttccccccagaatccccatatccaaaaatccattcctgcaaaggctgatgggtaaagacggtttgttgctgccacaaagaacccccttctgttcatcctcacccctaacacctgtgccagcttccccagtcatgcgcaatttcctttgcccatcacccattggagaactgccgacttcactcagatgcccagaccggggttccccactcaagtccaacccacccagctcccagccaatcatcttccctggaacttctcacatttttcatttctaattcttcacctggatgtctagactgcagacccacaggtcacttacagcatctatgtggtggcttaaccagacccagcaaaggggaagaaatgcaggagcaacgcaaggagccagcagggcctttcttgggacattttaactcaagacacagagaggctggtggccgtgagggccactgcacggagggcgcttcctgacatgcaggtgttcaaaatgtaatgaggcagaaaaagctgtgtcacctggcagctggcacagattgcctcctatgggtcgcaggtgaaacagcctttattggaaaagatgctttgacaatgaaaggggcagagatgcacccttcacccaggatccatgtgttccctgcaaccagggcttctggggaagaggtggtcctggaaggcttcccagaggaagcgcattcagggtgggatctccagaggcaagaggtaacagccaaagtggggtgagtgggagttgtggggacagggagggggctggggaggactggaagctactggggctgtgtctgaagagcagacccagcaagacgtggctgcacaatggctgacaccatcaaagaaacccttttcctctcctctcctttcctcttcttgtcgccccttcatttagacaactcctccattgcgacgattaggttggtgcaaaagtaattgcagaaaaaaaaaagtcattgtggtaatactaacaagccaagcacatccacttaacttccccagtgcactcagcattttatatgcattgtctcatttcagccaaccacgctataaagacagaagatgagtttttgtgtccattttactgtgcagactgagtcactgagcggttagggttatgtcatgagtaacggcagagccaggaattaaaccccattgcccaagctgtccttgactttcaatctgacctggttcattgccctgaaacactaggggttccagttgaatgaccagagaccctagggtgtgtggctcaaaacaaatttctcggaggccatcactgggggtgatgcagcagagtcccttccccacacctcactgcatctccctctgcacggttgccagtggacagccagaggaatccctcttcccctcgtgaaaacagctgtcaccgaaaagggatggagctggggcttccttctaaatcccttttctctggaaagtaaaggagaaaagtcccgagagcaaggaatgtctcacagaaagcaaaccatctcctgggcttctggactcgacattttccctgagtggtggtggggtgaggggacagagagcgtgagggacaggaggagtgggggcgctgtaccaaagtcaacatttaaaatctatttctcttcccctgaatttttcagacttgcagccatgaggaattgtttccttaattatattcaacttccagcacactcttggctgaagtttaggtgatgttgcgtaaagcaaaatgagaaacacagggcatccatctgtgtgtatgcttatatgtatatgaatatttactcatatattaaatttccctccacccctgtctccatctcctcatttagcaaagaaataaaaggaccactgggctgaagctcaaatccctcctaagcagagggaaatctgggtgtcatggtttccagaaagggaacacaatccccgtatggggtgtaattacatcttagctttctgcagaagaatagtttatggcttaaatgctattaattgtaagccgttttgttccatgggaagttgttcattgataactacccaattagggttattttgcaattagtctattcacagtaaatttattgcaaatgggggagtctgtggtgtagcaaattaaagcgtcgctgaggctgggtgtgcaatggcttttaaatgccaatcttattaaccagctcacaggtcctgggagggtgcgctatcctggccagtgcactaaaggcctcaggacaaactccggcaaactcacactgcaaagccatccggagataacctcagcatgaccaggagaagtgcaggaacccctggcctaagatgctgaggttctgatttttttgaacaactgtggagcagtcataaagcaaatagggatgcaatgtacattagcactaccaggtacagttcttagctgtgtactaggcccttggaaaccctctaagctaagtgtgatgatgctcatctcccctttacagatggagaaactgaggcacagagaggtcaagcaacttgcccaaagtcctacagcttgtgcacgggacacctgggattcagatccacgtggtctgcctccaccaccccaggctcttaagcactgacagcatcagcacccctggcttcccaataatgccctgccttcttctcccttgcaacttgagagagagagagagagagagagagagagagagagagagcgagcctgcaggtggaagaacacctctggggcttgacaatgtgagataaagtgacccttctgcctccccaagagggacaggcttatggaaagggatacaggctctgtaacatgagttccagtaccagctctgtcatctgctggccatgtgtttctggccaaggactccccttccttgagcctcgatttcctcactgacaaaaagggttcacaatagactcagcctgtagggctggtgtggggacacagtgtgacaaggcagtgttgcacatattagcacaggtgacccttgaacagcacaggtttgaaccacacgggtccatttataaacagattttcttccctcctgccatccctgagacagcagtaataccaacctctcctccttcttctcctccttttcctcaactcaacataaagacaaggatgaaggcctttatgatgatccacttccacttaatgaacagtaaatatactttctcctccttatgattttcttaacttcttttctctagcttacttacatttatttatttatttacaattttttgttgacagagtcccgccctgttgcctaggctggagtgcaatggcacaatctcagctcactgcagcctccacctcccaagcttaagcgattctcctgcctcagcctcccgagtagctgggattacaggcatgcgccaccacacccagctaagttttgtattttcagtagagacagggttttaccatgtggcccaggctggtcttgaactgatgacctcgggtgatccacctgcctcggcctcccaaagtgctgggattacaggcatgagccaccgtgcctggcctagcttactttattataagaatacagtaaataatggaagtaacatataaaatatgtgtttatcaactgtttatgttaccagtaagctttcagtcaacacaggctattatcagttaaggttttcagggagtcaaaagttgtgctctattttttgactgcaaggaggttggcacccctaaccccagaattcttcaagggtcaactatagacagtgatagcattttgcagggttaagaaaactaaaagcccaagggccaaatccggcccatggcctattctttctttttcctttttttctttttcttttttttttttttttttgagatggagtcttgctctgttgcccaggctggagggcagtggcatgatctcagctcactgcaacctctgccccttgggttcaagcaattctcctgcctcagcctctagagtagctgggattacaggtgcacaccaccatgcccagctaatttttttgtatttttagtagagatgaggtttcgccatgttggccaggctggtctcgaactcctgatctcaaatgatctgcctacctcagtctcccaaagtgctgggattacaggcatgaaccaccacacccagccagcctatttttataagttaggtttaatgggaacatagcgcatttgtgtatgtgtggtctctggctgcttctgccctatgacggatggcagacttgaatagctgtgacaaagactggcccccaaatcctcaaatgcctaagatctggcccttcacagaacaaatgtgctgtctctgatatacagaaggagctcaatatttcgttcatggaatggcattcaactcaggcctccaaaacttctccaccaggcacaggttaacaaaagatgctggaaacgttgcactccacttaattattgctacactctgtgtgccaaatctaatcaagaatatagacaggaaccacctcgaccacttagacaagggtgaaacagcaaggcagaaaggaagcttttctttctaaatctttctatttaaaagtatcgtgtaggccaggcactgtggctcatgcctgtaatcccagcactttgggaggccgaggtgtgtggatcatttgaggtcaggagtttgagaccaacggggccaacatggtgaaaccccacctctactaaaaatacaaaaattatccaggagaggtggcaggcacctgtaatctcagctactcgggaggctaaggcaggagaatcacttgaacctaagagttgaaggttgcagtgatctaagatggcaccactgcactccagcctgggcgacagagcgagactgtctcaaaaaaacaaaacaaaacaaaacagatagaaaacaaaagtattgcacagacacatgcttgctactagaaactaaaataatatagatgcacttgttaaagttgtccctgctgccaccctgtccctgcagatgggggggccataaggaaggtttgctgtctatccatccagccctctttctgtgcaatgagtgtaggtggccacctcctatttgatctaaatcctctattctgtgaccagtggtaaacacagaggcacatatttaaaatgaaaaacacctctaattaactgggggacctggcataagtctcctcccctctatgagcctcatgttcttatctgtccagggaatcgaatgaagagttctcaccaggcgcggtggctcacccctgtaatcccagcactttggggggccgaggcgggtggatcactaggtcaggagttcaagaccagcctggccaagatggtgaaaccctgtctctactaaaaatacaaaaattagctgggtgtgatggcgggcgcctgtaatcccagttactcgggaggctgaggcagggaactgcttgaacctgggaggtggaggttgcagtgagccgagatcatgccactgcactccagcatgatgacagagtgagactccgtctcgaaaaaaaaaacaaaaaaaagagtagcgaatgaagagttctcttaagaggtctttttagtctacttttctggggagccattctcttgctgcacttcctttcttcatcaagagagttgggtgaattgaccatttgccttctcaggaggacaccaggcaaagccttgcatggctcccggatgcaccgatgccggtggaacggaaagcccttcctccccaattctgcagctggcttgattctctgactttatgccttgacattgagcagcacctcagtggatcccttccagctgcatctgttgaccctgacacctccccaatctccatctagctcgactctgacatgcccccaaccccatcggagcccccagagctctctgttgcctccttgctggcctccgtgctcatttaagggtcttttcccttcggagataacaaaagcaggggttggtatttggatttagaagcgacaagggggtactgtgaacctttggccactttgtgagggacagctgggctggccttgcagtgtggcccaatgagaaggagggatggccaggagtaaagagtgaagtaggctcccagggaaggtggagcaaaaagacccctagaatgcaagctgctccctggacagataagaaatctaggccctgagagcagaaaggactctccctgttagctggtagctgagcttgaatgaaatccacacccgtttatttcaaatgcattcctctctgtttgttgctagtggcaccaactcttcgtgggaaggtgccttttggatgctatccgccctctccacagagaaaaccactgagcaaacgaattcacaaacattttgagaatatcttctccaaggaaaaaagtaaaatttaagagtgctcccagaggctggattatcgtaagctatggtggcaggggctagcgggagggaagggggcgtgccctaaacaacagtgaccacgagtcaataaacagcgaccacgtggctgggtgatggtacattggggttctctctactctgagtgggtccgaaatttcctgccataacagtaagcttgtaagatcacttaaaggccatgtgaccttgggagagggattttacatctctcatctgaaaaaaattgggctcatgacatcagcatcagcctcagagagtgttggatgtgataaacaaattgactgcacagagcctggtgcggtgtctagcacacagcgaagcctcagcagccccctgtggctgctgtcattccccttccaagggcactagagaaggtgaaaatcactaccaagaaatacacatcaatggcacgattgcacatgcgctagtgaaactggactccccatcttcagatggcccctccactctgcctgtgaatttctggatcagagcttggatccctccgtgtctcagcaagagagctggtttatcatcaggtcatccgcacataaaagagtgccagtgaagggaaagagggaggggaaaagcaaagagcaaggaaaggtggaaagaaggaaggaaggaaggaagtaaagaatgaaggaaggaaaagaagaaaggagggagggaggagagaaaaattaggaaagaagaggacagaaagcaggaaggaatgtagaagggaagaaagaaaataggaagaaaagaggaaaggagagagaaagaaaattaaaataaggaagaaaggaaataggaaagaaggaagggggaagagaggaaaataaggaagggaatgagaagagggaagaaaaggaaagggagaaacaaaccaggaagaaaatgaggaaggaagggaggaaaaagggagaaagaaaataaaggaatgagaaggaaagaaggagggaaacaggaaacatatgaggaagaaagagaagagaagagggaaagaaacttttgatgaaggaaaacggaaagttacagagcctctgaagttaatgcaaccaattagaaacctctcaaatcataatcaattacaataatattcatatcaattctaatcccaatattctactgaaagagaaacgaaaccatatcaatacagctcccttggctcctgccagcatcacatcagctcccgatttcactataatttcatcctttgccataaaggcaatgggttaaagcacctacaaaaggtaatctgattttgcaaaatttttctgatacaagacttcaacactcagggagtactagaacacatcagatctcgtgtgctcatctggggtttggaaaacagggtggcctttctcagaaggtctgagaaggtgagcagaatggggctgggcaggaggaggaagtggccaggagatccctctctgagccagcggggttggaacttaccctcgagggggcagaaccgagtcaccttctcaggcatcagcagccctaacttgtggcggcagtaagtctccccaatctcctggcggcagtgcttggacttagcacgggacagggcagagatggcctccttgcctgagatgtcacacttagggggctggtcatacttggtctcgggggagctgcccccagttttcctggcatgaggcggtctggacacatccttcccgtggctgctgttggctgcggctctgtccccgggaggcagcacctcaccggggcctttcccagggaatgtatgtccttttcctttctcctgctgttccagcttccttttcaaaagctccttctgtctactcggtggcttcttcgccaactcaggctggtgcttctgcttttgagtcctgggtgcgaagttgctgttgtcgacattctcaaagtctttggggacagagttctcgttgttgctgtctgttcgcactttctctttcggccgatgagaaaagtagccatcctggagaagaggggagagaaacagaagagaaacttgactgagagatcatgctaagcagactggcctttgaagagtgagtcatacggacttggaagccggggccatagtttcacatcctacttttgctactggtttaacctctggtaagatggctctctctggacctcagtttccccatctggaaataggagatgttccaaccagaaaccaaggctttttcaagctctaaagtgccatgactacgattctcaatgcttcttattaaccacaccttttcaagtcagtttctttccttgactgtctttgccactgggtaacaaacattttgttccagcgtcccgtttaaattccagctgaaagtgctgtgatggtttacttaagggctggaaatgatataataaagttataaagggaaaaatattggtaggatattacatacattccattgcctttaggacatgctcatatatctatgcccataagagaaatcagactgagccgttgtaaattctgtgggaaagaaaccagccgcaattttttttttttttttttaagaggaatgcagcccttgtagaataaactttacactaagtcctggagcaaagcaaacttgcgacactcttgtgcttgagtttggctcttcatgtgtgtacatggaacagaagtgatgaagtcatttggggtcaagacaaagatcaggagtcattctggagaccacgcatggcatggatgtttccagaagggctggaccccaaactcagctcctccatgggtaaatgggtcctggttactttgatcagtcgaatgatcaaatgcatcattcaaccaatgccccaaattgtttctgcaacatgttgcttctgcttaaagctcattcccaaggccttaatctgaaagcatatccaatgtcctacaacacggcccctgacctctgaagccacagagaagagtaatggctccatatagctgcccttgttgctatggaaacacaggggcaatgggcggcatccctgctagtcctccttttaaggagggctgaaatatgcctcttaccagttcccaaggaaaaaggtgtcggggcctgaacagcggatctgcaggggtacccaagagcagctgaccctcagcaaggctcccaccccagcaggtcagcaaacaactgcctgtgttttttataaataaagttttattgaaacacagccatacctgtccatttgtgtattgtccatggctgctttcctgatacaatagcagagtgaatagttgcaatagaaactttctggtctgaaaagcttaaaatatttctatccagccctttaagaaaatgtatgcagacccctgctctgctggagtgtgagttaaaaggcctcctcctctgggactgggttagttgcttctgtcctcaccatccatatacgacttagtgatggcctggagaagaaggtgcccctaggactgggcgtggtggctcacacctgtaatcccagtactttgggaggccgaggcaggtgaatcacttgaggtgaggagtttgagaccagcctggtcaacatggcaaaaccccatctctaccaataacacacacacacaaaaaatagctaggggtggtggtgcacacctgtagtctcagctaactcagaaatctgaggcaggagaattgcttgaacctgggaggcggaggttgcagtgagctgagattgcaccaatgtattccagcctggggggagagtgaaactggctctcaaaaaaaaaaaaaaaaaaaaaagatgctcctctagcctctgctccattgctcctagcagtaagcacgaatttctcctatttgttggaggctctgacactaagacaccttgtggccattctgtaagctgagtactgctatgactttcattttgcagatgggaaactaagcacccatgaacaagtgacttgcccagggtcacccagctagttggcggtgaagctggaattcaaaccaggcagatcacagaccccacactctgggctaccagggacatgatccacttccaagaaattgtatgatccttattacacccatcacccaaaacccttaagtactgcaagctgacactgaaccacaagatctggcccctcccacccagctaaatgaatctgctagaggtgtgtgacctccaaattgcaatcttcaggctggctagtggcctattgtgttgcaggaagtcatatagagacagtaagcagcagccacgaagcacgtggagtctgaggctgcaggagctgggaggtaacaaggtaggaagaaggaaaaagaaccaagaaaaaaacagctgaccagtccatattgggtcacagggcggctactggttgtacacaggaactgcttttatatcctgacctataaatgagggccttctgcttctggtctttcttattctccacagatacctacaaaaaaaatccccttcagttggtacctagagtacatctttattcttgtaacctaaacaaaacctgctgatgttcctcttttccctttttttctatccagaggcccttgaagagtcccaagcagcctctcaggcgcattttctgagctcttaccatgagccaggcaccacagtaagttattcacaggtattacttatagggtactgacaattggatgtatttatcttgccattttatagaacgaggagccaacgcttgttgtgatacattcttcactatggatcacgtgctaggtgccatgctaagcccttggatgcagtacctcacttaactcctggaaataatttccaacgtaggcactactgttcgcccaccttacagaaaagggtggaaaataaggttggggatgtcgagtaatttgcacaaattcatgttggggaggcagcgaacttgcatctgcctgattctaaaatctgctattgtatcacgcctcttgtgttttgctgagaagtaaatcaagaagcattcagttcccctgcagtggaataatgggtatcaccatctttgctcatattagcgtctgtcgggatggagctgatggggcaggggtggcattcaataaagctatgaaaaatcatttctgttccattccttctagggatgtgttaggattgtatgtccctatcccttgtatattaggcacagacaggaaacatgctatggccaagagcagtgactggaacccataaggtgtcattccctggataccacaatatccagccacactcctgctggtggaggtcatgcatccctgagtgaggcccatgtggagtagagactctaccaaccctcagtgtgcagaaattgacccctgctgctttgagtcactgagatttgggggatctgtgttactgtagcatggtctaactcatcccgattaatccaggagctaacctgatctcctttcttcctttgagctgagtcaggtacaggagccaatttttttctccctccaacagacagaaacatctattgacgactcccatgctccaagaacataaatttaaattctgtccctaagcccattttctagaagtttctagaaatgtctaaagggcagggagtaagccagaagagctactgccctgatggacatcttcgttttctctcttcagacatatcctaagtgtcattctggggcccttctctttccttgttatcagcaagtttccccgccacacaacagaaaacctccacaaacccccatttcaaaagctcctgttctccatcactttctggctgaactttgccaagcaaaaccagacagaaaacactgcgatcatctccctccaccccccacggccaatgaagctaatctgacaatcagagaatggccaattcctctggctaatgtgtaatatcaggaagaggcaccaccattgattctgatgggactcatgattaatacccgctctctactcaagacaggccaccacaatggcgatgattagcttgtggtggccctgtgaacttctgcctggccccagatgctactcagctgccatgggaacccaaaagatttgagtataagagggaaggaaaatattttgtcttctggaacaaaagggctcacagatactagatcgcttccagaaaagtcagagagaggcgcagtcagcgagaattggaggcctgagaatttctgtccctcagagtcactgtcattttctatagtgactgcggcgttctctctggcttccccccttcaattcatttttttcttttcttttcttttttgagatggagtttcactcttgtcacctaggctggagtgcaacggcgccatcttggctcactgtaacctccgcctcccaggttcaagtgattctcctgcctcagcctcctgagtagctgggattacaggtgtgtgctaccacgcccggctaatttttgtatttttagtagagacgggttttcaccatgttggccaggctggtctcgaactcctgacctcaggtgatccacccacatcaacctccaaaagtgctgggactactatgataataacacttaacatgagatctaccctctgaaccaatttttaagtgtgtattattgttgactatgcagctatagtcaacactatagtactatatgcaacatacagcaaattgttgtatattgttgcatgtactactatattgttggctatagtactgcacagcaggtctctatggcttcttcattgtgcatgcatgattgagatgttatgcctgtccatcagcaactccccatgctcctccccaatcccccaactcctggcaactactacttcactctctggttctaggattcggactattttcgatagctgatagaagcagaataaacacgtgtactatctgtccttctgtgactggtttctttcagttagcataatgtcctcagagttcatccatgttgctgtatgttgcaggattttcttctttttgaagctaacatccattgtgtgtatatgccacattttctttatccagccatccaaggatggacatgacatatcacttcatgttccccctaactcttcatctgactgccaaggggcaaacagattttggcttttctgtcctttctgtggagactcaagatccagaaagccaaacccaggatcccttcccttcacaaaaccaatcttgggaggtctccaggcagacccataaaaaataaccatcatatgcccagcacccaagtggcccatgctctgtgtcctttgaatcttcttgaaaactcaccaaaacagacagtattagtactccttaagaggaggaaactaacatagagagaggttaaataacttgaccgaggctacactgctagtaatgaagtgattcaaactctctgtgtctcagtttcctcatttaaaacattgggatgataacaccttggtatccatggggatgataataatatccatctcaggccgggcacagtggctcacacctgtaatcccagcactttgggaggctgaggcggtcggatcatgaagtccggagatcgagaccatcctggctaacactgtgaaaccccgtctctactaaaaatacaaaaaattagctgggcgtggtggcacgcacctgtagtcccagctactcaggaggctgaggcaggagaatcgcttgaacccaggagatggaggttgcagtgagccaagatcgtgccctgcactgcagcctgggtgacagagtgagactctgtctcaaaacaaacaaacaacacctcacctcttgggtaattcagtgaggaagagtgtatgtaaaactactagaatatgcccaccacacaaagctggaagaagaatgagcagtaaaccagactggggaactctaccaattaacactctctctcccctgacagtctctgcctagaggacagatgggttattatttcgcaattgtgatcaactggcatcatcttctctactcttcatcaatccaactctctcaccttgagttatttatgctaatgcaaccctttgacttactttattttaatgtacttattacaatgattgcacattcaaatgtttgtgtgcaagctccaaaactctaattgctctgctgttgccttacctctaagctgctgctagaatccatttttattctggagaaataattaaatgcaataatgtcctccattcccattcaaccttgggcatgtttagagtcaatttcaatcaggtagaaatatgctaaacataatatggctccgagaagcaggttacctgacccacgctgctgctgcaaagacacgtgggtctgtttccatttttcccaggttctcttggttcaggatgaatcaatacttagtctactgaatcctggccccttgctcccatttctgaggggtgggggtgggttgccgtgatttttaaactatccacctttgctcttattgtttatgtaggagaagacctgggtactagtattgcattagctgatgtccaattttcttatctgtaaaatgatgtgtcccgaatgtgtgttactaaccattctgagttagttattaatcaatatattcaatgaacaaaattctgccacttcagctcattaaaacaattcgatggaccttaagagaccaggaactgaggacaaaatggaagcttcaaagcgcatcccgtctgcagccctatccctctattatcgtctatagcagcacactgagattcagaggtctggactcaggaagaagtgagtttgattcctcccttctccatttgctggggttcttcaagctgggacagaacatttcgcctctctttgcctcagtttcctcatccatcccagagagccgaagatggcacctacttcccagggactgaatcgatcaagcatagaagatagtgcctgacacgtccaaagtgcttaagaaacacgtatgtcttaggttccgttccaagcctgttgcatgtactaactcatttaatctccatgatgagctgataaagaagacgctatattttctacccatttttcagattggaacattaaggttcagggaggttaaatgactaagtccacacacctaggaaacagaggagccaggatttgaacccaggctgtctaggtctggaggtcatgcctttcaataccccactgcctctccgcagctattaggaatagggacagggccaaagggaaaccccagccaggtgcactgctcacacatgagggcgcctggcccacccgctcatcgtgatcagtttacggcttccttttgtgccatgtgcacgcacagccggctgggtagttatttggtgttgaactcagtgtccgaggcttcgttccaatcaccaaggctaccaaggccactgggagggacaaacagggagaggcctgcacctgcttccaaaaggacctccgtgccagggtaggcgaacggtggaagcacagtgtgtgtggctgtaccaattagaacatgcaattacccaggctgccaatgcaaatagacctaacagaggcccctcgtccagctcatctgcatgcacaaaaggtggctggccagcacttagaaacccgtggaccacgctggacgcaggcaggccctgctttaacagaaccctaagtaaaaagccctttgcaatgtagcatcatgttaatgggatgcaaaacagcacagggtgaggcaggaaggagtgagactgatagggctgggttggaatccagtctctgctccttaactctgagacggagggcaagaggtttaacctctcagagcctcatttttctcatctacaaaagaagggggtaagaagacctactttgcaaatgtaaggtggggattaactaatatgtcatgcacatataattctatttaacaaaacaacattgggtgagaggcttgatacatgttaagcactcaagtggcagcaggatgatattttaagctagcgccttgtcacttgatgagcaagtctgagtcttttgtttgtttgtttgagacggagtctcgctctgtcgcccaggctggagtgcagtggtgcgatcacgctcatcgcaagctccgcctcccgggttcacgccattctcctgcctcagcctcccgagtagctgggactacaggcgcccgccaccaagcccggctaatattttttgtattttttagtagagacggggtttcaccatgttagccaggatggtctcaatctcctgacctcatgatccgcccgcctcagcctcccaaagtgctgggattacaggcgtgagccaccacgcccggccaagactgagactttttggaaaggcagagtgttgaggcacagtgggttgaaatctggaccctggcctttgctcactgtgtggcccagggcacagtgcctaactttgtctgcctcagtttccttctctgtaaaatggggacaataatgagtacccaatctaatgaggctgttatgagaattaagagtcaatgaatttaaaacacttaatacctagaacttaataaatattaggtataatttattaaaatagaattaatgattgcaatggtgacttaaagtggttcttaaagtgtggtctgggaactgttgggggtccctgaggccttctcaggggatctttaatgacaaactattttcacgataatataaagacattattttcctttctcgcttactctctcatgagtgtacagtggagttttccagaaactccactgcacgtcatactgcatcagaaatcagaagcaaatgtgagaatctagctatcttctattaagccaggtgttacagagatttgcaaaaaatgtaaaacagtgcctcccttcttcctaaatttgttttcgttggggaaaaatatgcatacttttcataaatatattttatatacacaagtaataggttattatgactgtttttaagtgaattaataaacattttaagaatgccttagtttaaatattactatataggaagtaattgatagcacctacctaagccaaagctctttggtgttcctcaataatgtttgagactatacagcaatcctgagaccaagtttgagaactactgacataatacataagtacaatcagaaatatttactgattattaaaattaaaagtttaggattcttttatgtaggctgttttgctacatgccaagccttttgatttgtattttacttccatacacaatacacacacacagaacagatagaaatcgaagttgagtgataaatactttttttttttttttttttctgagacggagtttcgctctttgttgcccaggctggagtacagtggtgcaatctcggctcaccgcaacctccgcttcccgggttcaagcgattctcttgtctcagcttcccaagtagcacggattacaggtgcccgccaccatgcccgactaatttttgtatttttagtatagacagggtttcaccatgttggccaggctggtctcaaactcctgacttcaggtgatctgcctgccttggcctcccaaagtgctggaattacaggcgtgagccactgcgcccagccgataaatactttcctatagagagaggaacccaggcccctcaagtcctgaatcatcctcagggaggaagaatgacctgctgtcaagagttagtccttgatcaaactctagtcagcctcctctgccccctttttctactgggcctctcagctttacctataaagacttgaatgaaatgctaacgttgtttttctttttctttctttctttcttttttatttatttattttttgagacagggtctcattttgttccccaggctggagtacagtggtatgatcacgactcactgcagcctcaacctcctgacctcaagcgatcctcctgcctcagcctcctgagtagctgggactacacaggctttcaccactatacccagctttttaaattttttgtagagacaggaccttgctatgttgcctaggctggtctcaaactcctaggctcaggcaatccttggcttcctaaagtgctgagattacaagcgtgagctaccacgcctggcctgaaacactaacatagtttctcacagctcaaggcaacatccctgggatgaccccagctcctgcttaaagtgactgctttagaaaactcaaggctgccaaaataatttactgtttgttccagctaacacctctagacagggcatcatctcccagcctctgtaagagagcaggagccacacttcataaacagcagttagcaaacccatttgagtcacacatagaccaaccctcccttcctgcttttggtaattcttcacttccctgagtccactgagctcatctcccttccctccctcccacctctctccttctccctttattattattattattattattattatcattattttgagatggagtctccctctgttgcctaggctggagtgcaatggcatgatctctgctcagtgcaacctccgcctcccgggttcaagcaattctcctgcctcagcctcctgagtagctggaattacaggcgtgtgccacaatgcccagctaattttttttgtatttttagtagagatgggatttcaccatgttggtcaggctggtctcgaactcctgacctcgtgatccacctgccttggcctcccaaagtgctgggattacaggcgtgggccaccgcactctgcttccttctctctttaaaacacccagtcacctctgaacaaatccaagttgagttcagttccatgctggatgcttttcctattgcaacaggcattactgattaaatgtgcccttacccctttcatagggtctggctttgtttatgtttgacgcagcccaaggccacctagcctggacctcaagcctacaaggctaagtccttggggtaaaaaccaaagagcccagcaaagcgtgctcagagcccagcccctgacttaacccactcccctcttcccaaccccaccagggggacatgacagtgacagtcacagcgctcagagcacccaagggactgcaggcaggtggcagggaaagatctgaactggcatctcctggctctttccctatcagcataagagacagctgtgtggtacagagatacacagcagagggcgaaataatggcagaggagaaaaagacgaaaaggaaggaaatgcaagagaaaatggaacgagaagaagaaacaaacatcagctattgtttactatgtgctgattacctaccaggcacggagctaagcccgtggcttggcatcgctattcattcctcaaaattatctcaaaaagtaggtcaggggtcagcaaaacaccctaccacctgcttttgtcaataaagttcttccaggacacagccatgcccattcgtgcacacactgaaggtggtgcttttgtgctaggacggcagagttgtgtagctatgacagagactacatgcccagaaaagccaacatctggctctccgcagaaaaaatgaatgccccttcaaatggggccagtgaggctgagccaggcttgcccaaggtcactcggtgggtaagaggcagggtcagaagtgacgcacaggagtcagactccagagacaacatgaggttgcaaagtcagacccaaggacagagggagagagagcagagccttccagaaatgacaacaaccatgtctgttttggaacaaaatgcctcacacacagaagagcttttctatggagagaggcctcctaactgttttttgtttgtttgtttgtttgtttgtttttaagtgtcccgaaggctggcctcttcttcgttactatttgaacacagtttgcctctaattaattgcagcattccattgcgttattccacagttatggccacaatacccaaagatccagagagaaagggggtgtggtagagacacagagagagagacacacagagaaagacacagagagagagagacacagagagacaaagagagagacacagagagaaagatacagagagaaagatacagagagagacacagagcaagagacacagagagagagacagagagggagacacacacacagataggcacagagagaatgtgaacaacccagtcttgctttaataataaagccttctgcgtacctctcaggcagggtttctcaaggacagcgctgttgacatttggggctggataactctttgttttaggggctatcttgtacattgcagggtatctagcagcatctgtgagctttacccactagaccccagtcatgtgcccttgttacaaccaaaaatgtctccagaccattgtcaaatgtctcctggagtaggagtggggcaaaatcaccttcccacccccgacccctgctgggaaccagggctcaagggcccatactggccgatctcagctgctcaaatcctgttcccattcagaaacagcctttctttccctcattttccaacagaaacagaccctggcatccagccagagcagtcagaataggagagaggctggtatgaagagagctggctggagaaagggccagagttaaccaaggaagggtattccagaggggacagagggaggaggctggctggggtgaccagggagaaatggcagctgcatgaggaaagcgggagaagttagggttcccgctagggaaggatgacacagaagaggagggacacattcatttgggcagtggatagtctttgagttgatggcatgtcttttaatttattttttgttgttggttttttttttttttttttttttttttgagacagagtctcgctttgtcacccaggctggagtgcagtggcacgatcttggctcactgcaacctcggcctccaaggttcaacaaaatcctcccacctcagcctcccaagtagctgggattacagatgcgcatcaccatgcccggctaattttttgtacttttagtagagacgcggtttcaccatgttggccaggctggtctcgaactcctgacctcaagtgatctgcctcccttggcctcccaaagtgctaagattacaggctttgagccactgcgcccggccatgtctcttaatttaagccagaagccacaaccgggaccaatggctccttcaggcacacaggtgtctggttcactctgtagactgttttcatttgtttaacttaatctcggcccacatttcaaaatctagagatttcatctaaaactttggatttctgccccttctggaaacatcagggacctgacaacactgagcttagatttctacgcatgacagttgtcttgaggctaagtagcggtcccatggtctccagaaggggcatctgctctgtccggcccggccagtgtccccttagccctctggcatgtctgcacgcggtgacactgcttcccaccaatgacacaggctcttccgggaggccttctacctcctgagctttgcctcggagatctcagaaccccaaaagatccttgtattccagagtgtttgatggaggtggcattgtccctaatgaggtgttctggaagcgtgtggtggcatttccagttatcacaatgattgggggatgctgttggcaatgagtgggtgggagaacatcagaaacccagcaggacaggggaacactcgtggctggacaatgaagagctgtcctgcatcctgcacatcttctgaacgtccccagatgtcctgtgcgtaaacaactcatttataattatccaggccaggagcctaacttagatttacatatgatacaacattattatgaatggttttaacatagctgaattttctaggaaagtaactactgtttcactcaagaagagattttatatcacttagtttgaccacagtttcagaaaattacatcatcaaaggccacacaagctgtggctgtgagtcaccaacacacacatccattccccgcctgcatttgtaactactgaattctcactgactcaatacgcagtagctgacctcttcatgtatcctccagccccttgcaaccaagtgtggaccactggccagcaacatctgcatcacctgggaacgtgttagatgtgcagaatctcaggccccagcctggaccacaggaatcagggtctgcacattaacagcatccccaagcaattcgtctgcacatcaaaaattgagaagtacgccaggcatggtggctcatgcctgtaatcccagcactttggaagtccgaggtgggcagatcactggagttcaggagttcgaggccagcctggctaacatgatgaaaccctgtctctactgaaaatatcaaaattagccagttgtagtggtgggtgcctgtaatcccacctactcgggaggctgaggcagaaggatcgcttgaacccgggaggcagaggttgcagtgagccaagatcatgccactgcactccagcctaggcgtcacagtgagaatctgtctcaaaaaaaaaaaaaaaaaattgagaagtgctaatgttgttgcacccatcattcattcggtcagtcagtcagtcattcgtttattttggagacagggtctcgatctgtcgtccaggctggagcgcagtagcatgatctcggctcactgcaacctctgcctcccgggttcaagtgattctcctgcctcagcctcccaagtagctggaattacaggtgcacgtcaccatgcctggctaatttttgtatttttagtagagacagcgtttcaccatgttggccaggctggtctggaactcctgacctcaagtgatccacctgcctcagcctcccaaagtgctgggattacaggcatcatcatttaaataataaaacatattatctgtttataaattgctgtcatatatttcttcttcatactattttagcagtctattgatcttttttagagttgtgggtgtttaagtaggatagaataaggctggatttcatttctggttgggtgaaaggaatgttttaaaagatttgtgacattgagcagggctgggtctgctggggttaaaatcacaggtttattcattccacatatgttatttgggtgtccactccctgacagatggggcaggggaaaaggatataggaaggggaactaaagtatgcttcctgctgttggtggaattctgagaaaagagaggaaagtaagtatgaatataagttattttaatataggaccaaaagggagtgtagggatgggtgtgctcaggatttgaatttcatcaagggtgtggagcctcacatggtctggggtccaaggagaatggaggagacttcacagagaaagcagttttccagcctcatcttgagaagaaaggagcaagacagacaaaggaaaaaagggctttccaggcaagggcaaagcatgtgcaaaggtgtggtgagaggaccagcccaactccttttataataacaacgatcccagctaacacttagtgaacatttactctaatgactgagctacacactttatatagattatctttaaaactctcagagcagggccgggcacggtggctcacatctgaaatcccagcactttgggaggctgaggcgtgggaattacttaagcccaagagttcaagagtagcctggccaacatggtgaaaccctgtctctactgaaaatacaaaaattagctgggcgtggtggtgtgcgcctgtaataccagctactcgggaggctgagggaggaaaaacgcttggacctgggaggtgggggttgtagtgagccaatattgcgccactgcactccagcctgagcaacagagggagactccatctcaaaaataaacaaacacatcaacaaacaaaaaaccccagaacaactctattgggtaggtgcaattagtatccacatttcacaggtgaaagtatggaggcatagagaggttaagtaacttgcctcaaatcacacagcatggttataaacttacattgttactcctgtgggctgttaacaactacgcttggctcagtgccccacaggtttctaaagtcccccccaggaggaaacaccacttccaccaaaggccctggaagaaagcaatcactaagtgagctgatctttggcctggggtggggaagggaggagtccagaagtaagagagttatctgaaaagcctgggttcctggtgtaaagtcctcttgcctggctgcctgtgattcattctctacctctgttatttgagattcatttctaggttggtgccacgcccctgactcctgaaagccacaaaccacaatattctatttgtcccctggttttatttccctatacaccttctctgtctctcttgattcaactcccaggaagccctcttgtcctaaccatcatccttcctccccaacattctccgatccaggtcctctgggacggggcacttaaggagacaaatgggtctcctgctgttgaaaaacacccagttttcaaactcatcctttgcctgtgtgggccctatcccccacacacaccctgccacagtgggtaatgaatggttcacttgtaagctcattaccgcagggcctctaaagaaatggaaatgctcacggagccagagacataaataaggagaggcgcctgtaaataaataaatatagatgcacatacacacacacaaacccagttaatttctatcatctgaaagccggaaccatttggggtggggagagagagaaagaaataggctcctaatattgccatccatgtgatttcagaactgagcttccccagaagctgctaataaattatttttactatgcagaggtacaaatgaatatgctgctgtcaccccctaaatctcctttatgagcatgtgtttgccttggcccaacctactggggacaggggcttccgagcaagttttcattggccaagttcctgaaggaggctgccatcttgaaggtctgctctctgtaagctgcgggtgccccactggcacttcctgtttatgcctgaggttggcatggcctgcaggacatccaatgtcgattggaaggccacaggaatcaaagtgacagcagtgcctacactcaagcttttggaaaatgatttctgcagcctggactgagagctgctgttcacaagatggaatgtacccctcttggccatatacttcaataggccctgacattttctaccaagtttcagggtggatatgcaaaaacctcatcactaccaactttcgcgtgcactgtcatcatccagaaggaaactctggtcactccctttggaggcagtgtatccaatgtccagttctccaactgttcagagcaagaagtaggccatggaaatcatggtgatcatgatatgctaccaggacacgatgggcaccgtccgatgaagttgttataaatgtatgccctggagtcactcttgaggatctgaaatccagctctaccacttcccagctgtgtgacctagggaaagtcgtttaccctctctgagccttgctttcctcctacgtaaactatctataatatcaaaacctcgcagggctaaaaagatacgctgacttaaccagtgcaaagacacagttcagaatagttagcagttaataaaaggtagcggttacccacatcatttcatgcgaactcctacaacgacttttcatacattcattcacagatatttactgagtgccaagtacatcttaggtgctggggacatgtctgtgaataagacagacagatgcctgctcctatcgagcttatattttaatagcatgagacagacaaccatcctaccaacaactcaataaacagattctatcacaatgttgggcatctgttatctatttttatctattttatttttataatttcaacttttattttagattctggggatccctgtgcaggttagttgcatgtgtgtattgtgtgatgctgaagtatggagtatgattgaccacttcacccaggtagtgagcgtagtacccaatggttagttttctaacccttgtccccctctagaagttctcggtgtctactgtcaccacctttttgctttttgtttttccagacaaagtctctgtcatccaggctggagtgcagtggcgcgatctccaatcactgcaacctctgcctccggggttcaagagattctcctgcctcagcctcctgagtaggtgggattacagggatgcaccaccacacccagctaatttttgtatatttagtagagacggggtttcaccatgtaggccaggctgttctcgaactcctgacctcctgtgatccacctgcctcggcctcccaaagtgctgggattacaggggtgagcccccgggttcaacctactgttttcatctttatgttcacgtgtactcaatgtttagatcctaattccaagtgagaacatgtggtatgtagtcttctgttcctgcgtcattaatttgcttaggataatggcctccagctgcatccatgttgctgcaaaggacctgattttgttcttttgtattacccactgttcccagatgtgggaactgaggctcacagcggttatctcagcaggtttatgagccagagttgtcccacccaggagagttttggaagtgagaggagcaaccagcaagagaggccggctgcctggctgacaggtaaaagctttgtttcctcctcctcctgcccctcctgccatgattgacagagtgagacgcctccctgcgaacatgaggcatctagttcgggtagacagtttgctactggagaagttccttattcaaggggctgagcagtagtggcaccttttcgtgtatgaccagccagccgtgcccagacttctgaagtctggctggattcagacaccgaactccctttagtcctcaaaggacccatgaaacacccaacacaaggtggttccaagagacccggtggaccgcagttgttcaggccactagatggctctttctgtgaaatttgcagagagcaagccggcagctgcaccttgatactgaagccgggctgcttccctttggacagtcaggacgcatctccgagaagttcttcttcattgccgcaggtgggtgggtcactacctcttcctttaaggggtattcccattaaggcttttcacttcagaggagtttgacaaggcgagactgggatttccacactgtctactaaatcaaagtcattgccatcatgcaactttctgctaactttcccagcttcaagggaaaagtggagcttcatggagctccacttcatcatctgttggcttcacatcatcccatcagagacaagctccatataacagcatctactgtttacccaagattttgcacgattctcttgtttcatcctcccatttatctttggtggagatattatccgatgagatagaaaagtaaactgtggcacagaaagggggttacatgactcaggcaaagtcgcccaggaagcaaggggcaaggctgggatccatcctaggtctgattctgaagcttgtactcttcactttacagcctcatctatgcacagggaagatcctcctgagctctgcaagtgtccaaacttagaatgggcaaccaaggctgactgtgaacatttccttcctggttgggctttaggaagagaagcgaaatttgcctattacctctacacacctcctgagaccaggagaatcctgggtgacaccaggcattcaaggatttcatgatacagtctctccctccctaatgcacctttcagcgttgctactgggacagcatttcctgtgcctttttaaatttaatcctcttcacagccctctcaagaggcagcgcggctctgtgatcaggagcatgaatgctaaagccagactacctgggttctcaacttagccgtgccgttttgaagctgtgtgaccttgggcaggtttcccagctgtagccagctcatggagttgaaatgagaattaagtcaatgttgggaaaacacttaggacaaggcctggaacacaaattgtagctgttactagtatgatcattaatagtagtatgtcctttttcaacatttgagtaaacagaggctcagagaggtgaagacacttccttaaggccacacagatcagggatttaagccatagcaccagacctgggagccaagctaatattccctctccaacacagccccttcaagtcccaggctggaagtgagctgcccttcttagcagtgaaacacctagaaaattggctgacaatttatcgagggcgtcttcaacaagtgtgtcattttggatacactgtgggctaactattggtgcagagagtgggctgaggggtcagcttcttcagcatctggcttcatccatctctgggtcattgatggcttctgtcaagatggccaaagaagaccacgagagtcaggctaggcctcctcctctgcatattaattacagccaaggcaaaatgtggccacagcagcagttaggggacaacaggaccctgcaagtcctcaagcagtcaggcagaggacaccttgggcaccccgccctctgcccagcacaatcttccgtggcactgccgaggacctcagcaagatgcagacctccagggatgtcagcctgtctcctcctctaggtctgtcctctttctgtccctctgtttgtccctctcccctctctcaaccacctctccatcattctgcaatcaacatcctgcccatggtcagggatatctaaaaagctatccaggctgggcgtggtggctcatgcctataatcccagcattttgggaggccaaggcaggcagatgacttgaggtcaggagtttgagaccagcctggacaacatggcgaaacctcgtctctaataaagctacaaaaattatccaggcatggcggcagcacctgtaatcccagatactcgggaggctgaggtgggtgaatcgcttgaacccaggaggaagaggttgcagtgagccaagatcgtgccactgcactccagcctgggtgacagagcaacactctgtgtcaaaataaataaataaataaaaagctattcatcttctgaagaatggaggtggtcagattttgtcttattttctgaaacatacttcaatattttcctaatacaaatatgtgtcagatataaaaaattccaatacaatctagatttatgaaataattcaaaatgtattaaaatgtacagaaaaataatacagtgcccttccatgtaccaattttgttatgttttattcaattatttaaagaaattagactttgcagagacaactgggaagttcctcccagctttcaaccaccatctcccaacccagaggacacttctatccttcacattcatgtatttatatttttagttaatacgtatgtgttcacatacaatgtatagtgttattttgtgtatctgtaagtttgacaaaagggcaccgtgctgtaaatatctcctttgcgtttgcttgtgtcattcaatattagcatttctacccccatctcctctctccttttattttctctcttctcaattcttcttccctcaggtaacatgatgcagaaggaatgacagcatttagttcaccaattctcagccttgccttcccattggactaatctgggagccttcacaaaatgcagatgcccaggtgcccacacgggagatactggtttagtgggttggggctgggcctgggaatcacgatttctaaaagcccccagacagcgaggggtaagcaactggatttggcccctctttcagctttgggtacctgctgtgaatcaaggtcactcctgctcagaggccaggtgaaggaagcatctgataggctggcctgcagcatccaggggagcggctgaaggacaggtactagagctggaggcaggcatcagagccccagtgcccggtcacgcccggggttgtgactctgcttggctccatgcagcatccaggggagtggtggaaggacaggtaccagagctggaggcaggcatcagagctccgttgcctggccacacccggggttgtgacactgcttggctccatggtactctgtggaccctgctcccaccatctgtaaactgagtgtgctgggtgagggcagtacttcctaacacttcctcccttcactggataattttacttggctcacatttaaacataaacatttatgttgttaaaaaaaatgatggtcatgattcctaaaattcaaacaaaaggaaaaaggaacaatgctatggaaccctggctagaccaagttgcctggctaaggctctgaacccagagagtcctttgtctgttgcacagggaaatgtgtaagtgttggcaaggtgttaaggacatcagcaccgtgctgagactttctcattggtttaatccaagagattgcaggagcactggaaaggcaatcatttcctccctggatgattcaaagttatttaatatccacagaatccccgcaaatcatcttgggtgccaccgtgggccacaaacacttcttggaaacacatggacctgggtcagtccctctggtcccttatcacatggatgctgtagggttctatggttctatgggccatacctgagattccattacaggggaatgtcactcccctcccttctctctcagtctcccagaatggggatggatgaagagatccagggtgagctataattcccctcacccagccttaatctggctgtcttcccggccagagctctccaggcaactccactttctacctccaaataatgatggtagtactaagtgcagcactgactgtatgctaggaactgttctaagcaccctgcatggtctagtccttttaaacttcatggcagccctagggggcaaacacagtcagcactcctatttctaaaatggagaaactgaggcacagggaataaaataccttactgaagaccctcaccccagcccccgacttccctaccccctggccagtaagtagccacgaacaactgtactacaatgcccttttgaatggcgggggtgctgacagctgtctatttgctctaaagatgtggctgcttcagggagcaagtgagcagggggagaaagaggaaaagcatttttagaaattatttccgacaggtgaccacatactaaaataacaacatttggtttgccttgctagctggaggcaaaaatcggctcaggtgggagggtgaggctgcaggctaaatgcagacaaggctggcttgccctgagttggcccagttctaggaagggcaccggcatttctgccattaattgatgcactgggaacccccagcttggttttctttaaggagagaaggagctgggtctttcatggtgtaactgtgaaaatgagaacctcccaggggctgcaagacctggttgtatatggagtccagtgagctattttagggacgaagtgtaaaattgtggaaaacagttgtaacacaggatggggtgtgtgtatgaatatttttattgaaagcaagaatatttactgcatacttactatatgccactgttgtaagggattaacctgcattacactatttcatccttgcaaggatccttagatatagctactattgctaaccccatttcacagacaatgaaactgacacacagcaataagtcaccccccccaagtcacacagctagtaagcagctcgttcagagcataaaatccagggctcatcacctccaaacttcacatattgcatgcatagacccacatttccagaacgcctaagaaattcccagtcatccagcacgagtggatggaaatgaaggggcacatcccgtcctcgcttggaaggaagaaggagctagccctggaaaactgacagactggcacgtctggaggcaaagccaagccaacgggagcagatggagcccaggcagcagatgttaatacagtttgctttttccatatgctcttctgtttagctgtaataagtgaattgttctttaatatctgtcaggagctcaaactctgaaggccgggggcagtcacagtcactcaaaaagacacaaagggaagctggccagccgtctcttcacatcccagaggaagggtgcagaatgtgaagaaagatgccaaacacagcaaagtccaggtctttgtgtacacacacacgcatgtgcacacataggcacacacgcacacactcctcgcctgccatgacagtgagattctcacttgacattctagagtctttgaaatcctgcctcagcgtccttcccactcagtaataacaactaagtagaattttcagattttgcctttgaaatgacaacaatgaaagacccaatttgaaatgtataaagggctccaacggctttgctccttgggacttccaacgcaaccacaactcatttccttaatcaagggcagcagggccactgcagaaccctgtcttctgtcttaggatacttcacgtgtcttgggacatccagccccatcactattatcacataggggcggggtgtgatggtgacgtctgtgaacagtatttcttcaacgatatttccatttgacaaccatgaattaggactctcatatagtctcaccaacttcatcttctttctaagtatccagctgtgatactgttatccgcactaccactatacacccgcccagtcagagaataaacacagagggaaggtcccctggtcctcacagttccagctcaacatagagcagaggttgagttctgagctaaacctcagcattatcccttaaaatccacgtgaccttgggcaagttacttctgacatttctaagcctcagtttcttcatctattaaatggaaagaaatagcaccttcctccctcaacagtcctgttgcgaagatcaaatgttaagaaatgcaggttaagtgttcagcacagcaaccggtacttagcaaacacttactgaggagcagctactatttttttattattacttctatttctcattcattcattcatcccactaacactggagcaccttctaggcaacatacattgtgctaggtgctcagtagtgaacaaaacagattcagctcctgccctaatggaacttacattctacagggggagagataatagagaaataatagttgtccaatatgatatgacctggggatgagtactttaaagaaagataagacaggagagaggcagcggatggcatttcagatggggtcaggtaggaactctctgaggaggtagcatttgggtggcccaatggtaagatggagcttctccaaacacataccgggcaaaaggtaccaggcagcaggaatggtaaaagcaaaactctcacagctggggatggtgctgtgcacctgtagtcccagctacttgagaggctgaggcagggggatcacttgagcccaggagttcgaggctgcagtgagctacgactacaccactacactacagcctgagtgacggagtgagactctgtctctaaaaattaaaaatttaaaaagcaaagctctcaaggcagaaatggtctaggaccagtctagcagcaggaagaggaagatggggctgtgatatggagaatagactcatacagcacaggaaagcaagatggggctgaacctgggtacacagagaggagagaagtccgtatctcattctaagtgcactggggagccactgggggcttaagcaggagagcatgccagatctgactgatggatcctggaagagcccactcacccactgctcacagatgcagagagaggaagcaggggcagaaacaaaggtggatgcagccctggccaagtccagactgagatcagaatgcattgcctgggtgctgctccagcctcttctctccggggtgttgctggggagggatgagggaaaatgcacaagtgatgggaatttacttagaagtttctggctgcaagcttgggtgactagaatcacccaggaccccatggtagtgatgatctcacaccagcaaatggctttaaatcagaattcaaatgagtctggtaaaccaggataaagtgtgtaatttaaagcatcccggaagccctgggaacttgcgctagatgcttctcgatctgctctcaggggatctccagcattattctggagagatctggtagcagaattaatgactctggcatttcccacctgatctagggctttgatccttcctgccccatgactgtctcagaaccaaaggttgtgggacaatgggcactgtgcatgtgcccagaccaagaatcagcatttaggcctggctgcaaatttcaccatcatgcccgggggccctgctttctgctgatgtttcagccaggaatgccaggcccttcacccctcaccctggcttgcattcaaatgacccctgcctctgtctccttcaccagactttctcctcctcctctatgcctacagaacacttttaccaactccactacagaactttccacctgaattgcttgttaacatggtatagccccctaaaaatgtgtccttctgaggagcagaacttattcaagtttataacccccaagggtctagccccaaacctggtgtatctctgtgtgtgtgtgtgtgtgtgtgtgtgtgtgtgtgtgtgtgtgtgtccatgtgtgtgtgagtgagtgagagagagagagaaagagagagagacagagagacagagagagactgtgttatgccaatatcaacataaacagcagctaacacaatgggggtctgggcccacgtgcctctctgctaatcactaactttcatgatcttctctgaccctcacaataaacctgtcatagaggatctattattactccaaacatacttagactcaaaaaggctaggacatttgctcaaggtcccggcactagtaattggtaggactggaatttgaaccaggctcatgtaagctcataaatcaagacccttctccaccacacttacttgaaggggtaaacagagactgagcaatatgtgggaggagtgggtgggaggctggggagggaggtatggaataaataatcatggaaggggatggcagatggaaattagagaaattaatacatccaagaatgttctcagggttttggtcaaaccatggactgactcaccaatataaagaccactctccttgtcatcccaaaccattcaccttcaagtatccacggatctgcactgtcactttcttagcccaggtcaacctgtcacccatgtggatccttgatcaacacagcactaaaattgtatgtaaaactggcttagctaatactcattagctagccacacttaggcacattacgtatattagcttcttgaatcctcacaacaatccccatggataggtatcatcatcatcctcatcatcatcatcctcatcatcatccccatccttgttgtaaggttttccagcaagcaatggaagacggggacttgaacccaggtaatctgccaccttcaccacaaagtatagccatcgttgattgtgtccttacactgctctaagcatctccccatgtcttctgctttaagcaaacttatgagatggggagtgttttcattccaattttacagatgaggaaacttacgttcagagttcaaaccctgaattctgttcaggtgtttggggaggtcaaacccaccaaacaccacccagccaaggccacgatcattcactgatcctgcagctttatgagaataataaaaaagattccccttactctgggcaattgcagccctgagtctacagtatgccttgatgaccagagtgtaggtgaattttggctcctacttaactccctcctgtagttatatcctgaacaagcatacgcagaaacactgcagccagctaaaaataggcagaactgagattcaaacccaggcctggcgtggatctagtttttcatcatgtagatgctccatcacccactcagacaccactccccctctttttttttaatccagttcaagaatcaacccaatccaaggctgctcaattaacgctcagtgcagtatcctcaagcaggcaaacgctcagaacgtagacggatccctctagatcatactcctcccacctcctggggctgtggccacttcatcacagtctcagaaaaaactctgggctcacagaaggtaactctgcaccatgagacaatttgtcgaatccttgcagccggtaccgcatgtggccaaatctccccaccccaatcaggcagccacttcacacagtgacctttcctgatctgcactgtcaggctgcaatttagccattctgaggactctgttggaggctgcttcagccaaaagcttgcctctggggagccctcccagggccctggactccgttcagatgtcactttgcattaagggcccactgtgtggggctcctggagaggaagaaagcaaatctctgctgaatgtccctaagacagaagtcaagtgaggagcaggggaggcaaaagaaagacagacagacagacgctgggcatctaaagaaggggtggaggactggtagttccaactggcagcagaaataataataccaggagcttaacatttaccaatcacttaggaaaaaagattaatactaagtgagagtttaagatgtgccaggaactctattaggcataatttttctttttttttttttgagacagggtctggctctgttggccagctggagtgcagcagcataatcgtagctcactgccacctcaagtgaggctcaagtgatctcccacctcagcctcccgagtaaatgagactacaggcatacaccaccagctaatttatttatttatttgtagtagaagatgaggtcctactatgttgcccaggctggtctcaaactcctgagctcaagccatcctcccgcttcggcctcctaaactgctgggattacaggtgtgagccactgggccccacctagacataattcttcaggtgggggccggtaacagttactcctcccttctccaatataaaaatagtgcagtgtccaagcagagaggctacaagataaatcaattgccagcaaaacccttggtgtataacttagctatacagtttcactcatggcaagagtaacggcagctgggatttcttacttacctcctacctgtcagggattgtgtgtgattcttttgttcttcttggggcttgtcttattatgcttattgtagaccgactgtactgatggtcccaagcaatggcctgctgtatgcttgcccttggcaatgtgccctgctgcttctcccaagaggttgagatgacttgtccataccttgaatatgggcaggtcatgcgacctgctttggccaaaagaaggtagcagaggtgaccctaagtttggcttctctgtcttggaaccctgtcactgccatttgctctctactggaggatgagagaccacgtggaggcgagtccaaatgactttcctctcagttgagataatcctagaccagcttagaggcagccaatctccagacatgacagcccaactgagatcaggagaaccaccactgagaccagaagaaccatctagctcacccaaagactcttgaacagtaacaaataaaaatttcttaccgttttaccccactgagtgttgaggtgatttgttaaaacatcccaagaatacaataaatagatttttttaaaaaacctgagcctcagagacataaagtcacttgtctaaggcaacccagctgataagagatggagctgggattctacaccattgtaagttttcatccacgatgatctatacctagggtcaagaaatcattttctgtaaaggactggctaataaatattttaggccttgtaagccatacagtctctgcctcaacctctcaaccctgccattgtagagtgaaaccagtcatagggcgtatgtaaatgaatggtgtgctgtgttccaataaaactttatttctaaaaacaggtggagggccagatttggcctgtgaatggcagtttgctacctcctgctctaggttgcttctctgtatcatcaccatttgtgccagcttttttcccctttctctgtctgtcgcctccctctttccctcctctagaatttccacataaaatcccgcaattgtcttctgccatgtttatgttctaccctgagacatgtgacaagtacctctcaactcaaggggctttgtttccccagcgtaagtgtgtctcaactccctgatttcataaatctatgtcatttccagaaatcagtttgactgatgtgttttcccaatgttaggatgatatctttctggattccctaggtatgggaatttaaaaagttctgattgcattccaaatccaagacccaacatcatcagggtgacagttgagaatgcaaatgactcctattcagaatattaaaaacaaaagcttcagttctgtacctaggaaaatttgactggctccaaaaaaaagtttgcaaaaaaccaaaatgaaaacaaaacaaacgcaaacatgcaaacaaaacaaaaccccaaacccagagtgatgcagaggaaagtctaagagctgtttcatgatcccacacaccccgtctctggggcaacctctctgtaagaagcaagaaaggaagatgacgatgactttctgcagagaacaaaaatttggcttgaagcaaatgaaatcccagtgattttccattttaaggatatctatctcatccaaaaaataaaatgttataatagatttcattttttccatctctttcttgttctttttgcctcttagctgtcctacttagaatatcgaaccgtgttggcaatcaaagtagactctgaacttggctactttctcctcagttaaaagaaaaagaaaaagaggtagacttgagtgtttagcaaagcagctcatccagtttagaggctgaaagccacatcttcaaaatttcaaccaaggaaagttagggttagtgtcaaactttccataatttttaacaactttctaagtaaaactagagatgtctatctggactgactttaattttaaaagtctaaagcaccaaaggcagcggaaggtccatctcatgtttcattacggttaaattctatttccaagaaccaccaacctcagtcccgggacctggcatggatgaagctatttctggaggctgccatgactcttggagccaagaacaaagtggaaggagacgccttacaggcaggggccttcaaccgcatggaagtaccagcagatcctgtgttcagaatcccctactgtactcttagctccccaaactgttgaatcgacccaaggaggtgtcaaagcctaccatggagcatgcacttgtaaatgtctgcaaatgacatgggctttctctgtgttagatgtggaataatcactactaacataattatctccattataaagatgaagagactgaggccaaagtccaaggcccacagctagtgaagggcagagctgagattcacagccagctcatctgacttcagggcctatctgaaacatgacaaaataactgacttggtaaatgatcctattaatttgggtgatcagatagaggtggttacaatgtcctggggtggatcaacaccctggctctgccaccaaatcctgatcctcctcaggccacctgacaattgtcttattttattcatttatttatttttgagacacggtctctgtcacccaggctggagtgcaatggcgcaatcatatctcactgcatcctcagcctcccaggctcaagggatcctcccacttcagccttctgagtagcaaggactgcaggtgcacaccaccacacctggttaacttttttttggcagcgactgggttaatatatgatttagtgggcaccaccacacccagctaactggctatttatgacttttttgtagagaagaggttttgccatgttgccacagggctggtcttgaactcctggacccaagcgatcttcctgctttggcctctcaaactgctgggtgtgggtgtgagccattgtgcctggcctaattgtctcattttaaaagaactttcattcaatgagcagcatatgtaagatgtgggacctgtgaggttggcaggctgaggttatttcccattacacagatgtcgaaactgaggcccaggggtcctgcccactgttacccacctggtagtggcacagtcaagtatgaacaacagatcctgtgtgtccagcccagaaccaatagaggggtttggatttgggtggggtggaacacacccacctcaattttcccagcctctgtctgttctaaggccagaaatcctctgaggcccctgagctgtgttttcctaaagctctgaaggtcaaatacggtgctgaggacctcacacttagaatgtgctgagaaggggtacaggaatgaaagctgctggcttaagtgaaagacatatacaaaaagacctggaaattgtattttatcgcaatagctatttattcctgctgttcggtgttacaaaaatgccatgttccaaaaaggcttaaacaaaagacactgttccactgaccaaaaattaaacagataaaacacagtgtggggacgaggtgtggtaaggaaaggaatgaagagaaaagaatatgataggatggccaggcacggtagctgacacctgtaatcctagcacttagggaggccgagacctgtggatctcttgaccccaggagttcaagaccagcctgggcaacatggcaaaacatcgtctctacaaaaaaacccataaataattagccagctagccgggcatggtggtgcccactaaaccatacacacacacacacacacacacacatatacacatatatatctgtgtgtgtctatatatatgttttttgaaaggttctaaatattatatatattatatatacatgatgggaaattcaatttgccaccagaagcatttaaaataataccataggttttatgagagatatgacctctgtctctgagcttatgagacatgtgagagatatgaattgtctttgagcttcctagcaggcaatgcaaagagggaaacacaattagttatttgaatctgtgtcacagacgagattcctcacttcacaaaaaaaactctcccatctctatttttttcgtgttattatctcttgattgtgttctgtttctcacatatcagttccatctctgtatttgctgagctgatctgtgtatccaaaatgacctgctgtgcagggctcttcacaatagcccctgaaattcagagaggctggctgatgtggatccctgtacagctctggtatagtcaagtgtttatttactgagcgtcacctgaacagactggcgatgaaggagaagtttaaaaccactttggtaggagacgatgccaccagaatagcaatgggaaatgaagcagagaaatccctggcattaaagttgaagtgaatgagaaaagcacatttgtgttgacatcatccctgttggcccacacatggtctttcagaaacactttcctgcacaaagtggggcacatgggaatacagaggccacttcctcacatctctccacactttgcccagtcccacggtcagggatgagacgttcatccacttcatctcagccctgagcactaagggggccacagtgggcagggtcactgtgtgggagcctcaggaaccaggactctggcacatgctgggcagctccatgcaatggaattgtaagctgagttgggctccctgcaggcatgggagcatttcagagccaaaattcccacctgcagctacaagcaaagagagtggaggtcctactttagctaacccgtaaagcgggcacttccaagaagacttttactggaactctgtgctagaagattgggaagttgattctctgtcggctacccccactgctgcctaggggtcctggaaggttgggaggggaggagaggtgactgcaggacagggtatcatggcatccccgagtttacctccaccaaacacacccaaaacctctgtttaacacccaacaactagtatttaattttcattccgctgacctgggagcatctctctaatggaacttccacttagcatagccactgaagttccccagggacagtggtaccaattaaataacgtgacactttggaggtgtaaagctatgtatttactcccaaaccagaggcttgggtagtttttaacataaagattttctccctccttttttttttttttttttttttttttgagactgagtctccttctgtagtgcagcggcacaatcctggctcactgtaacctctgcctcttggcttcaagtgattctcctgtctcagcctcctgagtagctgggattataggcacccatcaccacacccagctaattgtttgtaattttggtagcgacaaggtcttaccacgttgcccaagctggtcttgaactcctgagctcaagtgatcctccctcctcggatgcccaaagtgctggggttacaggcgtgagccaccacgcccggccagaatctctctcttaagagtcaccactagtgcccaatgtttactgttcagaaaggtcattgcccagcagttgcaggcaagaaaccctggacgcatcttggggaaatgcatctaaacaatgcagagcagaagacaggaggggttcatgctctgagtacaggctctggggtcagagaagaatgggtccagatcccagctccatggctgtgcaatcttgaacaagttgcttaaccactctgggcctcactgtcctcacctgtaaaataaggtgttcctgaggcattaggaatgccctgggcgactgtgctgagaatgcaggagcagttacaaggctaagcaactgttcctctgaaggggtcccctgctcagcagagcctcaaaatttggtcctgtctctgcttagggctttctgacaaagcagagtggggaagggaaagggaggtttctggaaaagccagtggccaacttctgggtaccgcggacaggtggcaacacctgtccaaggaccaggcatctctcaggctgtttctaggctgctccacatgagggagaaatgatgggctttgctggccagcccaacaccgtcagagggcatgttactgctcgaaagtacaaaataagcagagtgcgcataactaaacactatttttatcgtctttccgccactctcatgccacaagcaagagctgctgtgtaagggagggtggcagggagatgtttattcagagcatggggtggcctgaataccaatggggccagttgagaggctgtgttgtaagggcttttaggggacagcacccaggagaatcgcagccaccctcaaggctgacctaggagacaaaattgccttcctccccaaactcagccctgcaccctgctgccctgggtgaggaccttatctttcccccacctaggaatctgcaagggtatctttcccttagcatcaggaacaaaacttaccctccagctctgggcaagaaggatctgaaaatgacagttctagggtcgtttggggcaggtacaagcacccttattcctggtgtccagacagtgcatggtgtaggtatacagcaggtactagatgacaattccataaaagaagtaacatccaagggcttgggaggcatctacgaagaatggcaacaaaacccttgccttcacagaactttattctagcacagggacacagaaagatgacagatataacaaatagtgcacagaatagggtagaagagagaagtcagtggttaggatgatgcaatgggtgcatttcttaataaggtggtcaaggcaggctttagactgaaaaggtgaggtataagcaaagactcccagtgggtaagtgagcatgctgcttggctaactgggaaaaagcatttcggggacagggaaactgctgtgcaaaggccctgaggtgacagcaagcctcacgttgctggtggagaccagcaaagaagccagggtggaggaagtaaaagatgaaaaacagaagcttaggtcaggaagaaatgggggatagatcaataaagcattatagagccaggtttttgttttgttttgttttgttttgttttgttttgtttttggagacagattcttgccctgtcacacaggctggagtgcagtggtacgatctcggctcactgcaacctccatctcccaggttcaagcaattctcccacctcagcttccagagtagccgggattacaggtgtgtgctgccatgcccagacaatttttgtatttttagtagagatggggtttcaccaggttggccgggctggtctcgaactcctgacctcaggtgatctgaccactttgacctcccaaagtcctgggattataggcgtgagccaccacacccgacccaagagctatagttcttaactgggtcaacttgacccacaggggacatcttgccatgtctggagacatttttgttgtcacacttggggaaggggaatgctaccagcaactagtgggtagagtccagagatgctgcttaatatcctgtaatgcacaggacgaccctccacaactaagaatgatctggccccacatgtcaacaagttcaaatctagaccactgtaaggcctctggcttttgctctgaatgagctgggattatttggtgaatgaatgaaccccctctgtgcttgcactgatgataacacagactgtaaatctggaggtgtttcatcttcctccaaaccatttctcgcattcatagagtaaggaagaaagaaaagacaccttttttttttttttctccctgcgccaaaagcacacagtggaactcctggttttgaaatgtcctattttatgtgggacctaaaaggatgccaactgtcttctggcctagtgacaacaaaagtgacttcttggaaagctgcggtaacatggaggtggctagggagcagtccaagggaacaaaacaaaacaaaacaaaacaaacctaaaccaaaccatgtttagcaaggcctggggggtgttggggtaccacaggaggcaggctcagcgcgtttatccccatgtaaagattgcagagatggggctggggcttcgcgggtgatttttttagtgctttcacctctaatctccaaatcctagccctgctccttccagaaacctacagccttgcctaaattttgtgtgggtgattaaagcagaggacccgattccctgttcctgcctctctgtttgtgaataatcaaaggctaatcagccaaggccccaggggacaggaaattagacgtgcaagataccagagaggctctgagaataaaactgcgaggtgaatctgacatcaatgccagcaggggtgtctgggctctgatgggcaggagcgcagagcccggggccaactggggacaaatccgatttctccagggctcagctgacctctggcttacaccaaagacagagaaggacaggctgcaagaatctggcttttctccatcagctcagggatcagtcaaatcaaagcattaagaatccagggtgaactctgatattagcgagggcaaaggggatgttctccagactgacacaaaccaccggggttcaaatccccgctcctccacttcctggctgtgttacagtctaaggtctttgagtctcaatttccttatctgtaaaatggaatcaaatacaaataatcaggaatgactttccgagtttcttttggtagaagagtggaaatgaatggagaggaggaagcagaagtactatttagtgactcttgtgagctagacattgtgctcaatgctttagatttatgtttatcgaattctcctaacaactcaatgcagtattggatattccattttcatatgaaaatgctgaggtctcaaaggataaagcacttgcttgagtcagggaaatgaatcccctttccatctgcctccaaatccatgttttattagtaacaccacccaacacagagcactttgaacttctcatgtgtactgccatgctgggtccttataatatatatcagcacgggtgcagtggctcacgcctataatcccagcactccaggaagccaaggcaggaggatcacttgaggccaggagttcgagaacagcctgggcaacaaagtgagacccgcccccaccgacggtgtctctaggaaaagtaaaaaacttagctgggtatcatggagaacgcctgtaatcccagcactctaggaagccaaggcaagatcacttgaggccagcggttcaagaccagcctggagaacaagtgaggaccccatctctaaagaaaatgaaaaaaaaaaaaaaacttagcttggtatgggggcccatgcctatagtcctcactactcaggaggctgaggtgggaggatcacttgagcctaggaggtcgaggctgcagtgagccatgatcatgccactgtgctccaacctaggccacagagtgagaccttgtctctataaaacaaaacaaaaggccgggcgcggtggctcacgcctgtaatcccaccactttgggaggtcgaggcgggcagatcatgaggtcaggagatcgagaccatcctggctaacacggtgaaaccccgcctctactaaaaatacaaaacattagccgggcgtggtggtgtgtgcctgtagtcccagctactcgggaggctgaggcaggagaatggcgtgaacccgggaggtggagcttgcagtgagccgagatcgcgccactgcactccagcctgggcgacgagcgagactccgtctcaaaaaaaaaaaaaaaattattcctgccgagggagccagtgttaagagctatcacggctccattctacagatgaggaaactggagcacatcctgtaaggtctcacttgccaaaatttttgtctccaagagaaaaccagaccctcccttacaaaacaagtcaaaatgagtgtaaaatcggttccgtcaggtgacagccatgaggagacggatggtgtcacatctagtgggggcgagggaatgggctggaggtatagtgtgtccagttgcaggaccaaaaaaccttggcccataactaacgttccctgcacagccaccccatgccacacgcagagcccaggagatctcatctcatcttcacagcacgcctggtggcgagtgccctcactgttcccattttacagatgaggaagatgaggctcaaggagctgacgtcatttataccacactgctattgagtggaggactgcagagttgaaccgggttgcttagcacctttcctgctgctctgaggtcccttaaagtctctgtgaagcgtaaggatgggaggtgggagtcctgaaaaactggtctacctgctgctgtgcgagattgagttgggacagtcagctctcccctctctggcctcagtcttcacccggcagggaaggggctccactgaaggtccttcagctctgacctcctgtgctgctcttcatagaccgtcagctgctgcttcctaatgcaaatgctgtcacttgcctcagggcctttgcacttgctgttctccaggccaggaaaaatatccgtctggatatcctcatggttcactcctcaagcaacttgtcagaggacacgccctatgagagccaccaccccctgccccataggcattccccattcctctaattatgttgctcctcaggccacgtatcactctctgggctattaaagattataattataatctacaatgtctattattaatatgtataatatatatttgcttattgtctgaatatattctatttatatataatattatgtatttgcctattgtctaaatcttccaactagaacgcaagctacttttttatgtcccttcagtatgcacaaaccctggcacatgacaggcattgggtaaatatttgtggaatgaatgcctggatgcattaaatccatttctgggcacctactgcacttaaggcagacgggaaatgcacgtggttaacccaccaccaccagagcatccagctccatgcctttatcaacctggccaccatgtttcatcagcaaatgtgaattgggggaaataacagaatgaagagggggtggcagtaagccccagcaggcttcaggaccagataaaggaggccaaaagattccatttgcacaaaataccatgcagccctctccatcccgttaacccgctcttcctcaaggaacttccagaacaaactattgccaaacaccattgagtttaattactcagatgatattaatagtgcagccagctttaattacagacgacgctgctgcacaggggctaaagacaccctctgaattgctagcgtcccttccacctcgcttctctagctgaggtcgccatatgtgggagttgatttagccttgactctgccatagagacttaccagcaagctttaggagaagagaggctttttgtcccctgcagaattgaatgggggccactcatgctagatttccctaactgccagaacatagctcttatataatgaaggcccaggaaggtctgcagaatgagactggttcgagttcttagagaaaagtttcagaaagacgagggacacaggaaggattctgcttttcccccatcctggtggacatgaaggacccaggataagctatgatgctgctttattaacgaccctttttcaaagcactgaccccggcagcaggaatggaatctggccgcctaggctttctgttaatgagatgagaactgaagttcaaaaataaactgtgggaagcctggtagggaaataccagatgacaagaggataatctggtgaccaaaggcataaaaggtggcgggggtggggagcccacagctaaatcaataaccaggtcgggaggaatttgggggtcaaaagagtggcttagctgttaagaacatggtgaaaactgaccttggatggctccgtaagaatcttagctttgtggagatatttttgtgcctctgacaaaatgctatcttttaagaagtgtgcacagacttcatttctaggcatgtaaccttcacatttaacttgcatttaagcaaaatgatatgcgtgtagggaggattgctatggcgagtttttaattgccaaagactagaaaccacttcagcctcagcagttgtggtatggttaaataaaccatgctatgtgaatgcaaatgcaaaataatgcagctatttctttctttcattctttcttttttttttttttttttttttgagatggagtcttgttctgttacccagtctggagtgcagcggcacgatctcggctcactgaaactgctgcctcctgggttcaagtgattctcctgccttagcctcccgagtggctggggttacaggcacctgccaccatacctggctaattttcatgtttttagtagtgacggggtttcatcaccaccttggccacgctggtctggaactcctgggctcagatgactgcccaccttagcctcccaaagtgctggagttacagatgtgaaccaccgcgcccagcctaatgcagctattaaaaagaatgggggccatgatatatatactgaaccagaacaatcgatgagctagataggtaagcgacaaaagcaagacacaaaataacacgtacagtttgctgctataagttagactgtgctttaagcaccgtctagagcaatccataagacaattcagatcctttctcattagctgtgcaactctgggtatgttactttacctctctgggcctccgttcctttctctctcaactagagctttaataggagttagtttgtatatctaaagcacatattctcaatagggatgactgtcacccccaccaagcaagcaaaatttgggggagtatatgtgtgtgagaaaaaaaaaatcttaggctgggcacagtggctcatacttataatcccagcacttcgggaggctgaggcgggtggattagttgaggttgggagtttgagaccagcctggccaacatggtgaaactctgtctctactacaaatataaaattagccaggcatggtggcgggcgcctataatcccagctactcaggaagctgaggcacgaaaatcccttgaactcaggaggcagtggttgcactgagccaagattgcaccactgtactccagcctgggcaacacaacacaactctgtctcaaaataataataatagtcttagatattgcaatggtcagccgtcccccaaagctcaaccctatctgataaaatcttttcccacagtatttaatttctctcacaagggagaatttatattaaattaaatttttcttcttgggagggtgataatgaaagaaagtaatgcttgagtaatactgagctaaagtactcagaacagcgtgaagcagatggggtgacatttaccttgcaatgtcgctgccaagtttaaatacaataatagatgcaaaggccacagtgcgaaggcgtttcatcagactccaccgcaacaacaggtggcgaatgctaatatcaactctcacttcttagatgaagactcggaggtttacaaaagtggaaagactaggccagaggtcagcatctgagctggaattttcacctggtctctctctcagactaagagcttcctctttatgctccagtggtgcttggagaccacatggtctgtttgttctggtagcttccctaaaatacatgtcagggctcggcacagtggctcatgcctgtaatctcagcactttgggaggccaaggtgggcggatcatttgaggtcagaagttcaagaccaatctggccaacatggtgaaaccccatctctactaaaaatgcaaaaattagccaggcgtggtggcatacaccctagctactcaggaggctaagatgggagaattgcttgaacccaccaggtggatgttgcagtgagccaagattgtgccactgcactccagcctgggtgacagagcaagactcgatctcaaaatactactactactactactactaataataataataataaaaaaatacatgtcgaggtcaacccaggcccaggtaccaggatgtgtccttactctgctgagtatcagcataagatgtcgagtctagaccaggggacaccgtcgtagcagacagccatgaatacctcatcctgtctgctgttagcaagctgcaaagcctgctggtccttcctcttcctcctcttgtgaggccctctggagaaatttccatctgaactgagcactgagaacagatccacctgccatgagcaatggcctgtgtcaattatttggatacagggcagtggaagggacagatttgttttccttgatggcagccagaaagctctttgtcaaatctccagttccccaccatggtgtaggtgttaatacctattccagctccaaggtatgatggtcctatggttgtgtttcctttctttgtctcagttttaatttttgcagtcttattttgtttagtacacccatgcagactgccataaacccttcctgaaagagggatgggtgtaaagagatgaatcaacaaaccacagaacttcaaaaggttccagaaaaaagccaccactggcacaataacgggttactcaatcccccaaggcttttgaggaagactagggaaggaaggggttgaccttgggtctagaatgggtgagggggagagaaaagagaaagcgagagagagctagcaagtgagcacacatgtgaccgtgagcttaatgcaaggggataagctggggtagggttggcagtatgggtagggaaggggagtacatgggaaaggaaaggggaggactggagcttcagtcgtgatggatcttgaaagacagaccactcactgattccttggtttactcattcattcattcaagaactaccatgtgcaaagaattgggctccctgcatgagatacaatgatgtaaaaaataatgacgtggttcctgccctcatggaaatcatatttagttcaggggttggcaaactacagctttaagaccaaatctggcctgcaatcctcttttgcgaaccaaagttttattggtacacaaccactcccgttcatttgcatattatctacagctactgtacagccacgctggcagaactgcttagcggtgacagagcccatgtggccagcaaaggctcagatatttactaatctatctggtcctctacagacagtttgcacacttctgctttagctgctattactgttgctgttgcatattatttgtgagcatataaaaatgtttccaataaacaaagagacatgttgatgcccccgtgagtccccagttttctctgccataaaactggcataagagggccattgtgagggttctaggaaaagctctaagaaataagcccagaacacagacacctacaatccttttacattttcattactaatgatattacaatggctgggagtaagaggaggaatcatttcacgccacatgtctgtctttaaaacacattcagccttttcactctgattctagaaacaggtatgattagttgatcaatgggacctcaatctagacaatccaggcatttgaccacattctcctgatttttcagatgaagattttttttcccatcattttgacatttctggaactgaggcttatcttataaacactgtgtacatatgatttattaatttgtatttgttaagagcaaatgatgtggcagacacacaagatacaggaacaaaatacatatgtgagcaatgcatgtgtgtatatacatgtgcgtgtgtgtgtgtgtgtgtacaggtgcatgcagatatatatgatagttcataagacatcaatttatgctaacgttggaaggtaagaaggcataatttatgcttatgttggaaggtaagaaggcagtaacaccttaaagtctgtcagttggtaataaccatcgtggtgaagggaaaaaaaagtagatcagaggaacagaggagagcagcagtttgcaattttcagagcaatggctgggatagcattcctcccaaaatgacctttgatcaaagaccagaggcaggtgaggagcagatgtgctggaattctggcttcaggcacaggtaagggcaggtgcaaagatgactatctctgtcagtgtgtctttttttccccctccttcctccccaaagctgttgccaacacaatactgtcctccagtcacagaaatgctgtatgtggatggtataagcatgctgcgaaaaaatgctgcagggatttggaccatttggaccgcgcaggggagggtgttaaagtgattgtaacatgttttatttcagctagttcttcaagctcagctcctttgaaatagctgacatgttttcttggccctcaacctgctgtaagcctacgtccaaaagcgtcatatgtcaacaacctggtaaatccacagttaagattttttttttcccacaaaaagtcatgggaaccaaacaggctctgaccaaagttgctggaccagttaaaccactaccagttacttctttgcccacggtgagtaaggctgcttgggaaggtaacctattttctctgaatactctcaaagcattcaagataaatatatctattcatttgtatatcccccaacttggcacagatgaggccttgggtttggatagtaaaatttaacactaccctatgacatttcaatgctaagtttcttggcaaactcaccaagattgcagctgtaggcccagaaagaaagggtgacagcttccagatggcacaggaatgatctggaagtccttgcatgtttatagcaccactcagtgccgcagggtgcccactgtgggccgggggtcatgtttaatttcactaactcctgatgatgagcctgcatcatctccctattgtacaaaggaggcgacagaggttcagcaaagtgctgactgcaaagccatcccagttccccaaatcaggatgcccccttgtcttgaccacccaggacaggatgggagtcattctccaacttagattccagttcatgtgtccaatgtgagcctaagactacagtaactaatctcactactttccctatctagtttccaaaacaaaatgtcctctggataagagcgaacagcagaatggagtttgtgtgtatgtgtgtgcagctttagttttcttaatatttacatataatacagaataccttcttcttcttcttttttttttttttttgagatggagtctcactctgtcacccaggctggagtgcagtggtgcgatctcggctcactgaaacctccgcctcctgggttcaagcgattcttctgcctcagcctcccgagtagctaggattacaggcatgcaccaccacgcccagctaacttttgtatttttagtagagacagggtttcaccatgttggccagggtggtctcgatctcctgacctcatgatccctccaccaccgcctcccaaagtgctgggattatagacgtgaataccttctttcttaacagcattaaacagacgaagtattgctcgactaagcatttgtaactataaggacccggcaaaccccagactctgacttccggagaactttatttccacatgaaaagagcccacacatgttagaaacagtcagtcctgtgttcagattccccttcccctgacaccgccgtggtggggagtccctgtgggggcagtcacttctttcttctaacctgagtctgactcatcctctcactcctctggctaaggacaggaagggacagtaccctctgagaacctgctgagaactgctgtgatgtcccttccctgacccaaacagaaggaggtacccctgaaaaggagacaggattaaaaagccaacccagagagcctctgggtgccaaaggactgccgaagctctttaccctccctctgtatgtggaaatttcagggtaacttaccaagtgctttcttctcttaggagccacagtctgtgtgtactcagattgggagaatgcaaatataagcggttgggagagggaaaaagaacaagagaataggagcgagaacattgggagagagagaacaagagacagataataaatgagaggagaaaaattcgagctacacaccattttcaccctatatactgactttgaagccttaaggtcagccaggcacagtggctcacgcctgtaatcccagcgctctgggaggccgaggcaggcggcgcgcatgtgtatactccaagctactctggaggctgaggcaggagaatggcttgaacccaggaggcaggggctgcagtgagctgagatcacaccactgcactccagcctgggtgacagagtgagactgtcacaaaagatatatatatatatatatattccctctaagtctaagtaagatacaattcctctatacgtgtgtgtttcactttatgcagcagacagacttccaaaaaactggatatgaataaatttcttaaaatctttttatatacatgaaaagtcacaactttaaggtaccccattcatgaggacatgaatcctttggtaagattaaacatccaaattcctagaaatatatccccttgggaattttgagtttcctagtcttgaatgtccttacattcatgaagtcaaaagggtattagaggcatctcttccagccccttcactatgcagaggaagaatctgaggcccagagaggcagggtgacttgcccaaggtcacacagctagagtgagtcagagctgaagcctgaacttgggagtgtagtctctgtagaggtgcacgtactggcggttactcacttgtgctacctgaaataaatggacctgagaatctggtagttatatgagcctgcagttttgtggggtttttgttgttgttgttgttgttgttgagacggagtctcactctactgcccaggctagagtgcaatgacattatctcaggtcactgtaacctccgcctcccgggttcaagcaattctcctgcctcagcctcctgagtagctgggattataggtgtagaccaccacgcccagtaatttttacattttagtagagatgaggtttcaccatgctggtcaggctggtctcgaactcctgacctcgtgatcggcccgcttcggcctcccaaaatgttgggattataggcatgagccaccatgcctggccgagtctgcagttttaatgccttattttctggaagtcaaaactgtattactgaggtgtttctctttttcattacaggagtcatctctattttatttatattttgcagtgaaatgatttaaatcaaatgtgcttgggtgcagaggaaatctgatctgaaagagagtttttatggcagagagagagccagcagatacttatttcctgccttgaagaggccagtaacatcctggtacaaggggattcatcaatacatctttcataagagggcttctctgcacagtgagctggaaaatctttccaatgactctggcccatttgtaactttgcccctgaataaaagaagggattgatcggggcttggaatgcttccatacccagggccttcctgcaccccaggaggcagagtctataaatggaattcaactgggcaattgctcatggagagaaaacccagcaggggtaagcacagcctctaaggagagggcagtgaagggttaaaggtgcaccaccttcctctgctggggtctgcagagggactgatgcctggaagtctctaaaataaagagtctcaaaaatagtcagagagacttgctattgggtattctatggactgcagatccattccccactctccatgatctgcagtgtatgctggtggtgggatataccctcagtgtgtccatcagtcagtcagttggcatttctcaagatctacaatgaaccaaagcagagtgagagagcttgaaggcttcgtaacatggcaaaggggcacggagaattgaaaagtatgtccagttcctgtagacacatcccacaaccccaacctcccaagatggtgccagtaagctttctgttgggtgagagaccaggagacctgagctccaccctggaccctgccacttaagttagcagctcttagggaactgatttctccctttgggcctcaaaagcatgtccaagttgactaagcctgctttaaaagttacttggagaagtgctgagatgattaaataaggacagagtccaacaccaggcacaggacaggccctgaatgaagagattacttcccttctccttagaacctttcctctcctcacccagctccctgtaaggtgaagatacagctctatctacaaagaacggtcacttctctcttcctttctctagggtggtttgggttcaaagacggaaactgtatttgcacccttgcaagctggttcggtccacacttgctttcctacccaaagaccaccacaatccctagcttctttagaacttccttggcatgtgaacttgaacaataccctactcttctccaagacccagtttcagggtaaatgggattagaaaacctaatttagtcagagttgctatgaagattagaaatcaataggtttcccagtacctgacacatggtagatgcccaataaatgaaatttattattttctgcaaggaaaataacatctatctcctctaattgtcatgaggattagaagtaaaatacaaagagcatttagcgcagtgtctggcgcaaaatagcggatactgtatacatcttggttgatggagacaaaagatcaaaagaggaacgtaaacgtgagcaaaagcaaaaaataaaaataaaaaaaaaaggttcaaggaaaaacaaacgtctagcccagagcctagcaatcagagagagctagaaagatatgcgcctaatgcaaagtaggagaggtggaaaggcggctcagagacacgcaagggtctacaacacagtttctcaaccttgacactgctgacattttgggctggatcattccgtcttgggtgagtgctgtcctatgcagtgtaggatgttgagcagcatccttggctctacccactagatgccagtagcatccgtcccccgtagttgtaacaactaaaaaaatgtctctggacattgccaaatgtcccttggggaggcctaattacccccagttgagagttgctagtctaaaatagtgtctgacacaccgtgggtcctcactcagcaaatacttgttgaaagaaggcagggatggaggggagagggatcaacgctgaccaccccatacctgggtagggcaagccctctggcttgcctgggctgcttcagccataatgaacgggtgggagggaggctcttcatggacatgcatcagcttggtttctctgaaacaggagggtgttcctagagtgtactgtctgtgctgtgccttgttaagaggggaaattttccaagaacctatttttccagcgctgcagatttcacgtggatatggccttaaacatccacaaccctgaacctgcatctcattcctctgccttcaaagggattctttggaagcacttcttgtcccaaatggtttaatgcctttattttgcgaatgagccattgcagtcaagaagattaacagggttaagatgtgtgcttgtggttctgggcttagtggtggaaaaatcatgcttcttgcttgtgaacttaaccttttggtggatggtgagaaaggctatgtggggagtgaaataaaatgcataggtcacgggggtaggggccccaggggccaggggtggcagggaagagatgccgtgtgtgctcaaaggcagctcaatttggaggctgggagtgggaacacatcatccctgtaaagatgggatcagattgaaacttctgggacctgatttcaggaatgagctgcaacaaaatgcccgcacacttcttgaacaccttccttttcctccccagctaaaatcctttcctgattcctcagtctcccttgggttcattcacttccctccagccctacttttcccctcttgcttctgggcagtatctttagccattaccaggttttcactcacaccaggacctttgcacatgccacttcctcttgctaaattaatcttcattccatttacacttcttcctttcagcttaaatgtcacttccccggggaaaggctcctgttccctttgggtcaagactcacagtcatacagtctccgtacactgggaatttaatcccatttcacttatcacagtcccactcagtgactggcatctgtccccaccagatagtgatgtggcctgagagcaggaattgcatcttctgctcaataatgtgccctcctcctactcagggtcagtaaacatctgtggaataagtaagtgcataaatggggaaaaggcaggcccggcgcagtggctcatgcctgtaatctcagcactttgggaggccagggcaggtggatcatgaggtcatgagttcaagaccagcctggctaacatggcgaaaccccatctctactaaaaatacaaaaattagccaggcgtggtggcacacacctgaaatcctagctactagggaggctgaggcaggagaatcacttgaacctaggaggcagaggttgcagtgagccgagatcgtgccactgcactctagcctggatgacagagcaagactccatctcaaaaataataataataaaggagagaaggaagagagagctttgttccgagtgtagacaaagagggtttctttcaggggtcatgtcccacagctccattcccagacaccattagaataaaacacagcatggtgtcagagcacggagaaaaaggtgaacttccttctgcctcctttccagctcacacgcatcttgtttccagccccaaacttgatgaagatggggctcccttccttgccttcagcccaggataatcacctgctgcaaatttacccggtgtttaaattgtaacagcaagtcaccaagctcttattgtcacagtagcagaaggggttacatcagagtagaagatgtggaccttggcctcaaggagcccagcagtatcagcactcaggagctggttagaaatgcagactcccaggccccacctcagatgggctgaattagaacctgcatcttaactaggtcctctggttcatgtgagcagcctcgtgggctgctcatgggcttcagtagcctgctcatcagaatcatctggaagatttgttaaactacagattgctagagccctgccttcacccccagtatgtgattccaagagtctgggggtggcaggtgaaggtgcgtttctttccatttcccatgtgatgcagctgctgttggttcaggaccacgcttcgagaacagctgccctactgctcagacccaggcacacagcttagtttccagccagatccatgggactgtgggtgaattccttccttcttcaacaacgttgatgctgatttcatgctgtttgtgcaacttaggcagtaaaaagtttcctttcccccttgtgtgtattagtctgttttcacactgctgataaaggcatgcccgagactgggtaatttattaagaaaaataagtttaatgaactcacagttccaagtggctggggaggccgcacaatcatggtggaaggcaaaaggcacgtcttacatggcagcaggcaaaaggaaaatgagagccaagcaaaaggggtttccccttataaaaccatcagatctcatgagacttattcactacaatgagaacaatataggggaaactgccccgatgattcagttatctcccactgggtccctccatggagggagggaattataggagctacaattcaagatgagatttgggtggggacacaaccaaaccatatcaatgggggtttaagcagaggtctgaggcccagaaaggccttctagaagagtcaaggtgtgagctggaggatgaaaaagagcttgccgacagacaagaggaagaggggcgttctagacacacagcactgcccaagccaaatgaagcaggcgtgaagccaggcacgcccagggggtgactcatctgctgtgcccagagctcaggccaggtaggagggagatccaggggaagggtagggcctggagatcacagaagttctgcctcctgttacctgtaagatccctgctggcatagtactgtgaaggactcaatgaaacatccctgaaatcctcatgatcatcagggctggcattcctgtagcgcttaccatgtatggggtcttgtctcagggccttacccgcattaacatgtttttctttctaacttaaaaaaataataattatagactcacaggaggttgccaagatagcagagttctgcactccctcacccagcttcccccaatggtgacatcttatgtaactgcagtgcaatattaaaaccaggcaattcacatcagtacaatactgttaacgggactgcagattttgtttttgttttcacccattttcaacatactcatgtgtgtatccgtgattctatttactgtttaatcttcacagcaatcctattatcccattttgcagatgggaaaactgaagcacagacagaataaagacagaataaagtgacttgtccaaggagctcgaattcagggaatctagctctaagctactatgcagtgttacttctccggcaagttctggtaactagtgcaaactcgctcatggatcagagatgtttctgagggtactcatatttgaaaaggacttctaggtgtcaaatgtaggttccagacccatcccaaagaaccggatcctcttggaaaagctccccctggccggggctgagcagggaagctgggagagagggcatgtccgcccagggccatggccacagatccccagccttgttggctcctggatagtctctatcccagctcaaaggtgtgcctgtctgcctcatctgctctcaggtttctggtctggtgatgttctcgggactggcctgggctgcctgccaacaccagaactagacaaaaatctgcagttctgagcctcagcccctgcccctggagccctggcaacttcacagaggcctgcttgtgaggccaggaagcaggaagctgggctgctcagccctccgccaacctccaggcccctggctgctggggctggaggagggagagagaaggggacagacaggacatccagtaaagctgtaacaccaccaaaaaaggcctcccacacaagccagccttggcagccagcgacctaccagacaaggcccccctttcctgctgacttttatggagtgttgggctccttggaagggaatgttccctgtgcttagaaatatgtggagatgatctatgcatgtggacagggactgcttagacccatgcacacagcttggtttctagccagatccgtgggactgtgggtgaattctttccttcaacagcattgatgctgctataatgctgtctgtgtaacttaggcaagaaaaggtttcctttcattagaggggaaaacatccaaaccattaaaaaaaaaaaaaagttcataggaatccatgatagcattgggagtggttctgcccagacatggagcgactgtggttaggacccaagaaacagcctcatctgttaacctctccaagactcagtatcctcagctgaaaagtgtggattaggctggaaggatccagcccaaactatgaacctacagggagaatgggaataaggggatataattaaggggcttttatttctattctgtccagagattcaaaatgcagttgcctcagacaggccaggcctcagccatgtgtcaaggtcatcagtgataaatcaatccaccctgggagggtcaggacactggagagggtctgtccagccaaaagaacattagaactcaattgttttaagacactctgcaggccaaaccaaacttgtcgactcactagttactagctttgaattctaaagtcgactcttgtccagaaatcatttcaggagctccaaaatctcaagatcaggagatcctagagaaagattagaagcaacaggccccttgtgtgtggcccttaagttaacacgtcactggctccccagcagggaacctggtgggccctgacttcaggagcctccccaggcccactcatcacccacaaaacagcacccttggggtgctgcagagagggaggaaaagtgcttagtcagcccaccccgctgcacgttgccgagtcagtcatttttttagagccctctagaaaccactagattccaggtcctagaatatgcactacaggcttcccttggagcatgagaagtacctctctgactcccaccaattgctcctccatgaatggcagccatccatccatctgctatccaagagaacgcatactgggtgaaaatgtatgcacaatcagctgagagcaacatgcgaaaccaaattattatctatcccctcccattccaggaaagaaaggcctgtgatgaaagacacagaaacaagaaaaccactacactagtgagagaaaaatcaataatcaaagtgatagaggagaaacttgacaaaccaaagctaacagaataattatgattaacattagatgaggctctgagctccctggtggccaaagcaaaaagggatgctttgtattatataactcatatacaacttgacagctagaagcttagccaaagaaaaagagaaaagttcagtcctggtacgagtttgtcaggcaggtgtgtaggtggcggaggtgataaagtagagaggtgagaggtacccaggtcaaatgcagcctggtgggccaaggtcaggccttggcttatactgaaagaggcatgaggagccacgtggcgggttattcgcagagtcaagacttcatctgactcatgatttaaaagagcagctctgggagctatgctggggatggcccacctggggaaaaggcagaaggagggaggaagatttagagactacagaaaaaagccaggcaagtccttaggagaaaatccattctccttcctaggactgacttacaaagctcagcatgtcctgaacctgcctctccattcaacccaaactcatttctctttccctccctccagctaccctggtctccatctatctcctgccttgtggatgctctttgtcaccttgtgcatttgcacatgttcttccccctactggcatgttcttctccccagcctcatcctttgcatctcagctgaaatgtcagtttcctggagagccatttcccaaacccctatcacaagtagagaattctcgctcccctaactctcaattctagaatcttctgcttctatctcagcactagtcacagcagatcgttattgtaacactgtacctatgtgttggttgttggttttgtcccgtctctctaccaggatgtctattattctaggaagtcaaagataagtctattcccattgcatttcctccagccccatagcataagacttggcacaaagtaggtgcttaataaattatggcgaacaaatggaccccatgaggcagacacagaattagcttcaggttagaaaacggaagctcagagaggctcaggcaacttgcccaaggtcacctggtggtagatctcaagtctgactccaaggctaggccctttgaccctatacccagtttctctgaactcaaattagatgaccttgccctgatcatgcctcggcaagtccctggtaggaggtccttaccactgcattaaaccaagatcttagcgctttgacaaagggccaacgagaacatgaagatgatctgtaaagtccctagaagacgccaggagaagcttaggaaattgcagccgcacctgggtcagatcccaacagagtacaacagcaaaggggcactaggaaatagcccccacctggttggccacactgcctccacctttcaccactcacaacacaaactattctccccgaagcgcacagcttttatctgatcaattttctaggctgtggaaccaaacagtggaatccacaggaaattaagcttattgactcagtctttgaacaccacatggagaagagatatttacacatgtcatcggagccctggggactgtaggttattggcagcatgtatttacagagtttcgcccaacagtggagatggggagaaaaaccaccatgcctccccctccatgcagatttggggaattcagagagatgaaacaagagttaggaccccctgctttttatttatttatttatttatttttgagacagtctctctctgtcgccccggctggagtgctgtggtgtgatctctgctcactgcagcctctacctcctgggctcaagtgattctcccacctcagcctcccaagtagttgggactacaggcacgtgccaccatgcctggatgattttgttaacttttgtagagacaaggtttcactatgttgtccaggttggtcttgaactcctggcctcaagtgatcctcctgcctcagcctcccaaagtgctgggattacaggcgtgagccacagcacccagccaggatccctgctcttgaggctctgttttacttctgcttggctggctcagacagcaggatttggtggtaaagctaattttacacagaccctgttacctgaaagagctcactttgaaaccacaggcagattttttttttttttttgagacggagtctcgctctgtcgcccaggctggagtgcagtggcgcaatctcggctcactgcaggctccgtcacctggggttcacgccattatcctgcctcagcctcccgagtagctgggactacaggcgcccgccacctcgcccggctaattttttgtatttttagtagagacggagtttcaccgtgttagccaggatggtctcgatctcctgacctcgtgatccgcccgcctcggcctcccaaagtgctgggattacaggcgtgagccaccgtgcccggcccccaggcagattttatggagctctcaatgttgcagcaataaactgtgatctgtttccccatctaggtgtttgcctcctgccatttcttcatggttccttgactgtaacttctctttgggtcatttacaattagagaggtgaggcaacctttgacattcttgacggatgccctggaagactggtaaatgaatgcccaaattaaaattaaccacaataaataatggcatcagatgaggcacagtggctcatgcctgtcatctcagcactttgggaggcctaggcgggagggtggtttgagcccaggagttcaagaccagcctgggtaacagagtagtaactcatcactacacaaaatacaaaacttagctgggtatggtagcatgtgtctgtcccaggtacctgggaggctgaggtgggaggatggcttgagcccaggagatcgagtttgcggtgagccataattgcaccactgcactccagcctgggccacggtgggagacgctgtctcaaaaaaaaaaaaaaaaaaaaaaaaaaaaaggcatcaggagctagtatttatggtatgcagtatctctttaccctcacatgttaaatcatgtttccttttgtaatcagaataaaatccaagctccttatcatagcctatgatgtcctacaggatctagctactgcccacctctgtaatgtcccctctcttcctctcactcatcaatatgtttcagccaccacggcgagctcattcctgcctcagggcatttgcacacactattcctctgcctggaatgcttttccctgcatccttgaatatctgtctagtttattcccattgctcaatgctgggatcagttaattacctaccccacaccagtcattacccgtcttgtcaccctgtttaaccattatcacagcaccttttcacttgtttgaagcgttcttatgtatttccttatgtgtttatcatctgtgtcttcttgctaaggtcggtgaagctgagaccttggattttcagatttccagattcccagtatatctaatgcctgacgtgataccaacacatagcggatgctgaataaatactcaaggaagaaatgaaagagagaatgggaactggaccctgggtttacttgatctcactccaaagccggggctcttaaccactgagctacacagcctcatcacaggacactctgctgaatcagcagctcctgttcaaacagctagacttccaaagtcaacaccagcacatggcttttcgggggaggagtacatttcatcacaaggccaagattgtgttttgttttgtaaatcacttcctaagtattaccaaggctcccacaccaatgaatccttcctcctttcctcctgcagggtagaaggtcctggcttggttctccaaccagctaaaggcctgtttcccgcatgcaaagatgatgtttgtgctttagcaaaatgcaacgtcatgcaatcctggggtcagttatgcagatccgaagcactactggaattcagaacctggttccatgaatttgttaactgagtctacagatgtatataatgaacttccagacactcaagacgatgcagagaaaaaccagaaaactatagtgggaaaagcaaggattatgatgacaagaactccatgtggttccatcctgggatctgcttactctttttttttttttttcttcagatgagtctaactctcgcccaggctgaagggcagtggcacgatctcagctccctgcaacctctgcttcctgggttcaagcgattctcctgcctcatcctctcgagtagctgggattacaggcatgtgccaccatgccggggtaatttttgtatttttagtagagacagggtttcaccatgttggcctggctggtctcaaactcctaacctcaggtgatctgcccgcctacgccttccaaagtgctgggattacaagcatgagccaccatgcctggcctctccttattctcttgctgggtgaacttgaatgagctacctccactttttaagcctcagttttcaagtacgtaaaatggaggcaatgactgtgcatttattgggaagggcttactttcaaggccacagaaagaaatacatgaaaaaaaatctatcagaatgcctggaacttataataaatgatcttgaaacatttgttcaatgcctaccatgttcaaggtgcagcacagtaccttgcctgagagattctaagagcatgacaggaagggtcctgtctttattctatttcccaaattccgcatcagaacacataggctgatcaaagaatgggtcagagagtgtgaaacagagaccattcaggaattttttttttttttggaaactaaatctgtgtcacccaggctggagtgcagtggcgcaatcgtggctcactgcaacctctgcctcccggattcaagcgattctcatgactcagcctcccaaataggtaggattacaggcaagcaccaccacgcccagctagtttttgtatttttagtacagtcagtttcaccatattggccaggctggtcttgaactcctggcctcaagtgatcctcccatgtcggcctcccaaagtgctgggattacaggcgtgagcccccacaccccgcccaggaacatctcatatcaagataccaagcctgaatttgaattccagctctgacatttgaggcacccctcaccccatttctgggccttagtttccccactgaatggaaataatggcctatgtcatctggccccttcgtacctctccaccttctcccatccccttttctcagctcccctccccactggaattcctggagtcttcaaccatgctaagcgccaggcagttcgcatgctcttttctttctgcccagaacagcctttcttctggctcttctgggactagctcctcattcaaccctcagtcttccctggccatcctacataacatagcccactccatttgatctgacagcagctccttcttcacttctttattaccactaatcaacatttgtagtgatatatgtattgtttgtttcctgtctctttcttccccagactacggaggttgtaaacattcagaaaaaggaaccgtgcctgttttgattagcagtgtatttccaaaaacctagcacagtgcctgaagcacagcaggtgctcaataaaggcttgatgaggggatgggtgaaagtttggcattccctccaatctatcgcatcaaggccttcatctaacccactatgaagaccctcaaacacaccattcccaatgcttacatccaaaacctctttctgccccacctcctgaggaaatggggcatgagttgtgagtttccttagctgtgtgaccttggaaaagtttcttttttttttttttttgagactgagtcttgctctgtcaccaggctgcagtgcagtggtgcgatatcggctcactgcaacctccgcctcctgggttcaagcgattctcctgcctcagcctcccaagtagctaggactacaggcccccaccaccacacccagctaatttttttgtatttttagtatagacgcggtttcaccatgttggccaggatggtcttgaactcctgacctcgtgatctgcccaccttgccctcccaaagtgctgggattacaggtatgagccaccgcatctggccgaccttggaaaagtttcttaaccactctgtgcctaggttttcttaccacggaaatgaggttaatgataatagttcctgactcatagaattgtttttggcactgcatgagttaacatacataaaggacttcggtaaaatatacgtaaggcacttagcactttttatgccttgtatgtgaataaatgtcatctagggtaggtggagccctgtccctaccattccatgcaggtttccctgagtacctttttttcacacaggtaggttagctcctcatctacaaagtgctcctcaactctgaggcccattggaatcacctagagagctacgaattaccctggagttgtatccatacccacaacatcagactccagtggggcaggctgtacatctgctttttactctccccgggtgattccaacatgaatctgaaattgaaaaccactataaacgcctcatgctcaaaggatctcacaactgcccactgcacactgccctccccaacaaactttactatttttactgtaatagcccacattggacagttcccaaagtactaactagcctttttttttttttttttttttttttttttttttttgaggcagtctcactttgtcatccaggctggagtgcagtggcatgacctcagttcactgcagccttgacttctttggttcaagcaattctcctgcctcagcctctcaagtagctgggattacaggaatgcaccaccacgctctgctactttttgtatttttagtagagatggggtttcaccatgttgggcaggctggtctcgaactcctgacctcaagtgatctccccgtgtcagactcccgaagtgctgggattacaggcatgagccaccacacccagctatctgttctgttctccttagagcagtggttctcaatcgggggcaattttgccctgtaggggacatatggcaatgtccatagacattgtggttccagggatggggtgctattggaatctactcggtagagaccagagatgcttctaaacatcctacagtacctgggaacccctgcacacaaaaaatgacttatccagccccaaatggtatggtggcaaggttggcaaaccctgctgcggagctatcttttctgtgaacttggggaggacagcgcagccttgctaacaatgggaaggaaagaagaagtagtgaagggaacttatcatcactgagtttcaacaccaaacacataccaagcagatgtttcacgaataatgacaatagccactactttctgagcaccaaacaatggcttacaacagaacggaacccctgagttatcttacttaactcacatggcaactctgagttctttgactgtgttttcgcttcatgcataagacagcggggacagcaaggttaggtaactaggccaaagtcacaagacttgtacatgacagatttagattttagcctattctgttaaacttcaaagagaaggctaccccaacagattaatgatgccagctcacacctcctaagcctcacagtacctaccaggcagtgctctgaagacccgacaagtagaaacttaattcattcccatgaactagataatataatcatcatcgtcatcatcatcatctccattttacatcctgggacgctgagacagagtgctgcagtgtcctttgaagaatttcatgcagctgagatagggttttaacaaggggtttagatccagaatctggctcactcccaccatactctcctgcctctaatagagcaatgagcagaaaggatcgaattccagcctgcctcaggacctctgcacatgctgctcctgatgatgtatatgtcttcactctggcctctttgccctgctaactcttttttactcattggatctcagtttatacttccattgtctaggacaccctcctagccctgccaactcactgaccagatgagttatctccgttaaactctctcctagctccccttcatagcatttcacactttaaaagaacccaacacttgtgcaagtgtttggtgaccatcagtctcctcctatagactatagactccatgcagacaggaactgtctctgccttgtgcagtgctgtatctccaggcccctggcatgatgtttggcacaaagggggtgcttgatgaaagcttgtggctgaatgcatgaaacagagaacctaaaggcaaaacagcagctggtgccaatccggtccatttcctcatccccagagagggacagggccatctggcaggtcctagccaaatacctccatggcaggtcagggctgcagagctctccaggcaagctggccatggaggccataaaccaactcctcaaagccatctctgcttcatggtggctggtctttatcattttccaatcaacactggttgagttctaattgattttctatgatatccctctccagaagggagaaaggctctgtttactggggcagtacgtagaggacaggcctattcttcctgctgtatttaatgctgctgctaatcacggagattagactaaaacaattacaacagctaattaaagaacaatgcggtttttggcatcttcgcgcagacggcaccattgggaattcctaactcgggcaaagcagggataattaaaaccccggctccactctccccactccagcagctggatcacgctgattaaactgcaaataaaacacatgaaaccaacactttgtagtctatccaatttcacttaaaagggcttttaactgattcataaacagagaagcggtaaacagcaaattatttaactaaagccagttatttcgtcatcacggttcactttattcccagctccggacttgtacatgtagcccaggggacattaggttgatggggcctgaggaatcactccagagcttactgccacttgctcctgttcactggcaacaggacatcaccagtgtgtagctgctttctctgggttttttctccttttgaaaaaaaaagatcaggtagtgcccaagtccccagatgaatatgcccaggtctgatcagactctgctctcgattctaggtcaagagcagatggcagagacacagaaagttccgaagcgcagataatactaaaagcatcatatgtagctttaaaacatttaacttattcagagctggccaacttcagatctaaaatgcaacccgtatctactaaagtatgaaacagacttgttctcaagctatgggaagacatgtcacaacagctgggtagaaagctcatttgttttagacaggcacactctgagaccccagctcaggtcccatgcacacatgcttcccaactcatcttaacaagcatggtcatggggattgctaattctctctccaccttgccaatccagagacaacaagggaaaaaagtgagaaataaaaagaaaaaggtcaagggaaaaagaaaaggacagaagagaaaagggagaaaatggtaacgctagagacaggctcactgggagcagcaagaagggacagaaaaagaaaaaaataccacaagaaagcagacacagggattttcagagcccagcatgacacatgcggtgaggacctaggagccagcgcctgtccctttgcagtggccaggtatgatggtcacgttccacagcagtgcttctcaaaccagctgtggagaaaggcctttgtatgcccagtctactgcagggtgctaattttgtaaaataaaacaaaaaaagaagcattaaaaataaaagattgacttgcttaggtgccatgccatgtccggttactataaaagctgctgaaagcttgtccttcgtttctgagcgcgtcttcgtgcacacagtgagaaaccctggggatggcactggtccatggaccgacaacgctctgagtagtcctttttgaaaagatcccccacggtcattgggaataaacataatcagattcataggattctatttaatgtgcaccacatgtttttagtgaacaaatgcaggctttcagacacacataaatgtagaaaacaaagaccggaaagacatgcatcaaagattttatttcggaataatgatttcaccgatctttcttctctttttttcaagctttgttataaaatactcatgaaagttatttttaaatgaatattccatttatgaaggcaaagaaagacgatgctttatcataacacgagttatagctatttatatataattatggatgttatttatttataagtatctattatgtggttcaaaaaacgctatgtaactgcatgtagcctcatggaaaaaaaaatatgcagccaatatatatgatgtttgaaaagaatactctgggcgggggtgccgggcacggtggctcatgcctgtaatcccagcactttgggaggctgaggtgggcagattgcctgaggtcaggagttcgagaccagtctggccaacatggtgaaaccctgtctctactaaaaatacaaaaaaattagctgggcataggtggcgtgcgcctgtaatcccagctacttgggaggctaagacaggggaattgcttgaaccagggtggtggaggttgcagtgagccaagatggtgccactgcactctagcctgggcgacagagcgagactctgtctcaaaacaaaaagaatactctgattttagaagatgcttttgcaatttgatcatcaaattgccaatattgacccttttctgaccaatgaaaacagcaatttcatataatttaatctaatattaaatgggatctaaaaggttcccataaatagaggttgaaatcaattatgtagaaaatacacatacacggaaaagaagactggaaaaaaacatacaaaaagctggcatggcgattttattttttccttcttggtcattttccaaatttccaaccgtgggaatatattgccttatgagtgggggaaaaaattccattcaaacatttaattcagagaaattgctagcatttttgagagtcttaccctaatctggctacttactctgtgtctatgtgtactgggagaaagaggataatgagaaatttaaattcataagtattaactgttagatgattattaaattagctcatcatttctaagcatgaactgggcaggaagcatcatgtctatgcaggggaaagcccctatgttcaggagggacctgagatccgtgttccgcttgtctgaatctgccatccattatcctgattgttttcaaacagctttactgaggtataactgacatacaaaaaaaagtgcatgtacttaatgtatgcattttgaagagtctggatacatgcacagactcgtgacaccatcaccacaatcaaggtaacagacatatccgtcacctctaaaagtctcgtgtcccccttttttggtggcaagaacattaacatgagatctactctcaatacatttttaagtatacaatgcagtattgttaactacaggtgctatgctgtccagcagatctccacaacttactcgtcttgcagaactgaaactttataccaattggaaaatgcctccccattttcctctcccccatcccgtggtaaccattcttttatccatcctcctgtgatcttgggcaagtaactccctctttttggcttcagttctcctacctttaaaataaagaattttgaaaggttgacctctaagctccttttgcctttggtattccatgctcttagtccatgatggctggaatagaccccctaagtcatgagacccaaggcaaaataaaaacacaggacctcggcctggcacggtggctcacgcctgtaatcccagcactttcggaggccgaggcgggcggatcacaaggtcaggagatcgagaccatcctggctgaaacggtgaaaccccttatctattaaaaaatacaaaaaaattagccgggcgtggtggcaggcacctgtagtcccagctacttgggagactgaggcaggagaatggcgtgaaccggggaggcggagcttgcagtgagccgagatcgcgccactgcactccagcctgggtgacagagtgagactccatctcaaaaacaaaaaaaaacaaaaaaaacaaaaacacaacaaaaaaaacacacaggacctcttatgcaaaattaattaagaatcttaggatgctgacaacagaaattcaaacaagtgcagagccatggagctgtgtgtgactgcacaggccgcatgtccatgaagccgaccctgctgatggcagaaggccaaggacaaacaccaccaaccaaaataaaaaattctcagttatacaatagacaagttctgaggagctaatggacagcacgggtggggaatgatgtgttcattcatttgtgtaatgtcatcatcacacaatgtatgtgtatatcaaatcatcacaccttgaacacattgaatacattcaacctttatattccaactaaacgttttaaattattttttaaaaagtgtttgagaggccaagcatgtatatttaagaattattcacaaagtagataaaacacctgtcaacaaaaacagccatactcgggttgaatgattaaaaacgagcaacaacttccttttcttttcttttttctttttttttttttttttttgagatagagtctcgctctgtttcccaggctggagtgcagtggcgccatcttggctcactgcaagctccgccccccgggttcacgccattctcttgcctcagcctctggagtagctgggactacaggcacccaccaccatgcccggctaattttttgtatttttagtagagacggagtttcaccgtgttagccaggatggtctcaatctcctgacctcgtgatcccgccccccccccccccccccccccgcctcggcctcccaaagtgctgggattacaggtgtgagccaccacgcctggccaacaactgccttttcataattgatcacaatcagcttctattttataactacgtcttggaataggccattatgcttggatttcacaggcaagtctgcattttcctcgtcttaaattccatcgcggtgagccaaactcagtcaaccttttctgtgctaacatctgtgatcaagattaaagtaactaacagccagctctggctcttgaagcataactggaggataagatcaggtatttgcaaagtgtgaggctccagccacactcctctgcttcaaggacttgatgttgccttgactatcgttactctgaacactgggaggagaggaccatcatggagggagaaattgagtccacctccctcctttgaattaattgcaggagtaaacaaccacagaccacgtaacctccctttcacagagctcggctgtacagaacagcctagaatagtagggagagacaggtgccccgggtttaccaccagagcctatttttctctgtattcatttctaatgaatgagattatttctagggttgagaagcagggccagctgattgtcacaatcaggcatattaaaagccatgataggccgggtgcagtggctcaaacctgtaatgccagcactttgggaggctgatgtgggcagatcacctgaggtcagcagtttgagaccagcctaagcaacatggcaaaaccccgtctctactaaaaatacaaaaaaattagccaggcatggtggcgcacatctgcaatcccagatactcgggaggctgaggcagaagaatcgcttgagcccaggaggtggaggttgcagtgagctgagattgtgccactgcactccagcttgggtgactgagcaagactccttctcaaaaaaaaaaaaaaaaaaaaaaaaaaaagaaggtgtgataaataacactaggcaagaaatgcaagagcagaaaaaaaattatcaaaaaagaggcagatttttattttttaaagggactccagggtcactgagtgaagagctacagcatttttgatgcccgtgcgcaaccatcagtgcttttagcagaatctaaaacctagtgcttgaaatgatggctggattcttcaaggaaggcttcacacacattcagcgtactctatttgagaaggcaggaaaataaatgggtgatagagtttagaaaaattccttaaaagtaaagcttaactctccagaaatgaggctcccaaagcctccaaaacgctccagatggctgaagttttgctggaggtatgcgtgtgtgcatgttcacattttgtagcatttctatgtactgcttttaaaaatccatccttatcacaggccttcttagaacagtggtttgcaaactttttcagtaaagggtcagacagttaagattttcagtttagcaggccacgtgatctctctcacaacggctcagctctgccgctgtagctcaaaacagacatagacgagtacgtaacaaatgggcgaggctgtgttccaataaaactccacttacaaaaacagatggctggcagcatttagcccatgagccgtagtttatcaagccctgctctgccacaaggaacatgggctctggacagggcaggatctggattcaaattatttcaatccaccactctgtaaccgtgagactcagtttccctcttttaccatggggggatataatacattgctgcgtaactgtaaacatcaattggaaaacatagtagatatttgatacatgttaacgtccttatgccaatagtaaatcttttcatcttgctggttttcttagttctttatctatacgggtcttcatccacatggttcttttcagtcaaaaatggcctttctccaacattatctcattgccccacccttttcccctctcatattccacaaggctggtagacagacatcactaactgctctactgataaggaaataaacactcatggaagtagtactccagccagggtagggaattacgtgctccaaaccagcaacctgtgcctccgggtctgttacttgcacaaacatggacacccgtgagtttgtagacatgcccacttggaaatctacacatggacacagaagaggcagttaaccatcacagggaggggcaccaggcttggatcccaccttggtgacatacagattgtgtatccccaggcaaggtacctgaccacacagtctgggtttcctcatttatgaaatgaggctaaaaatagcataggttccagaagtttctacctcaaaatgttgagcgtctaacacctagcccatagtacatgttccatcaatagctgttgaatgaaccaatgtgatggtgagggttaaatgagaacagtattcatagccccaggatgctcaataaatggtcacagctctgcttagtgacaaatctatatgcaccacatatggaggtagatacacacacacacacacacacacacacacacacagctgtcagctccacatgggcaggagccatatctgacacaaagcacttgctcattacaaaactgtgtgttcatttatgaatatacaacacactcgtgcgtataaacaaataagtgcaaacagctgataaactgggttgggctccccaaggtccttgcaattctctctctacatccactcaacccccagaaggagcagaacaggttgatccagacctcagatgatgaaattctgctggctgtttactggattccagaccaccaccacccatacatatcaaagacccgcatcgtttcactccctgggctgtgactccagggtcccataaggtgacccaggctagaggtgccatagaaaatgtccctgctgggccaggcatggtggctcacacctgtaatcctagcactttgggaggccgaggcaggcagatctcctaaggtcaggagttcgagaccagcctggccaacagggcaaaaccccgtctctactaaaaataaaaaaaaaaaaaattagctggatatggtgatacatgcctgtaattccagctactcgggaggctgaggcaggagaatcgcttgaacccgggaggcggaggtagtaatgagccaagatcgcgccattgcactccagcatgggggacaaagcaagactccctctcggaaaaaaaaaaaagaaaagaaaagaaaatgtccctacttaagatgtagaggagcaaggggcagtgatatcctcaatgcgcatatcaggtggcgtttgagcacctgaggagtttcagggactgctgcccttgaattgctgagatgaggttctacctttgaacaaagatggtccgtgcatttggaaggaaagagctgacagatgttccaccgccctgcacaaagggagggcttatgctcaaccaggtcctggccattcccatgggcagagcaggcagccactgggcactgccagcttttcccaatatctcctccgagtccccacagccccttggctctgtgcacaggcgaggccgcctctaaagccaagaaggcaatgacccaactctggaggagggggagatgactcaagctacagcacacaaggccttctcagggccgccttgaccatgccggcctcaatcccaggcagttgccttcaccacaccaaggtagagtactcggcacttggacagtggcgtcagaacaagggtggaggccatgtcctctcggcatgacatcaactaacagcctggctccttggccctgaaagagaatgagccaatgtctgcctctggccatgcaaaaccaatcctcatttagtctgtggaaacagtacatggaaggccagatgtagcctttggcttgaagaactgagtttgctcaacagacacacgttttccattcaacactctttctgatttggttgcggttgtactgctgttgtttaaaggagggagggattaaaccaccctttttgagaggataaatgtgtggtgggtctgtatatgttgatgacagacagatacacacacacatatggtagatgttaacgagcccattttattgatgggcacactgaggattgaccaggtgaatgacttatctcagattgagtccacagccaggactcaaaccaagatataattccactgtccacttttccccaccacactgtggtataaggcctaaaattaatattatgtgctgccttgacacctggggaaagccaagagcatctcatatggcttgaatgtaagtttccctaactactttgcttcctcaaataaggtcctctagccagacagcctcctttgtctcagcaagaccaggtacagtgcctgcctatccctggagagtgggtttctgttccctgccagcctctgggattatttaaacaagacaatcatatccccttgtgggacacagggattattgcatcttcttgcttctgcatagcctgcctcccatggcccctggatgttcaccctgtccccagatacaaccgtgtggccctgcatggtgcacagcacctgcttccctggggctgactgtacgtgacacataaactgctgtccatctggtctgtccagctttgggtgttatccccatagggtgggaatctacttcaaccatggggtgaagtggaggcgatcaaaacacacaccaggctgggtgtagtggctcatgcctataatcccagcactttggaaggctgaagcgggcagatcacttgaggtcaggagtttgagaccagcctggccagcatggggaaaccctgactctactaaaaatacaaaaattagccgggcgtggtggtgtgctcctgtaatcccagctactcgggaggctgaggcagaagaatcacttggacccgggaagcggaggttgcagtgagccaagatcgtgccactgcgctccagcctgggtgacagagccagagtccatcacacacatacacacacacacacacacacacacacacacacacacacacacacggcttcctgagcaaagtgggactattacaatttccacagaatgatattccaaagtccctctctagaggtcagcttgcaacacacctccccacaggtggacactggtcagttttggaagagacaggagccaaggactctggccttcagataactaaacctcaagttcattcctagactggccatttatagtcatccagtagatactccatcattccattgtcactcttccacctgtctgtccgcaggagctccgaattctgcaacctccgcctttccgtgtgtagctcaagcagaatccagagagggcatgagcagtgggtaacaagggcagagtgtttgcaaacccaggaagaggtgacggcacaggcaattagaggcagaaccctgattaactgagcccaactaaccagaaccatcaattaactcaaatcttttttttttcttccctctcaggagactgaggccaggaattgagaaaatcacaatttaaaatggaaaaaaaactgtgttccgggcttttctctggctcaactctgacccaggtccatttccttcatcctcattcaagacacatgtacaacttcaaattttctagtagctgtgttttttaaaaaagtaaaaagaaattgattaatctatttgatttaaccaaatacatcctaaatattgtcatttcatcatgtgatccatatggaaaaagtatcaaatctaaacaaatatgaaaaagcattaaggagatgttttatattcttttgtttgagctaagtttttcctagagcacagctcagttggaactggctgcatttcaagtgctcagtaaccctgtgtggctggtggctaccatatgggacagcacagatctggagctaaagtgtgaagtgattgtttagaatgatgattctggagggttgctagggtttcaacgtccatgtcacctccaaaattcatgttgaaattaattaattaattaatttaatttattttttttttttttgagatgaagtctcactctgccgcccaggctggagtgcagtggagccatctgggctcactgcaacctctgcctcccgagttcaagcaattctcctgccccggcctcccaagtaactgggattacaggcatgtaccaccatgcctggcccatttttgtatttttagtagagatggggtttcaccatgttggccagactggtctcgaactcctgacttcaagtgatctgcccacctcggcctcccaaagtgctgggattaaaactgtgagccacacgcccggcctcatgttgaaatttaatccccaagggaagagtattaagtggtgggtcctttaggaggtgatcaggccagaagagttccgctatcatgcatggggttagtcccttacaaaaggtatggagagaactaagtaaaccccttttgcccttccatccctttcaccatgtgaggtcacagagttcatcccctacaaataatacagtgacaaggcaccatctcggaagcagagagcaaccctcaccagaccccaaacctgctggcaccttgatcttggacttcccagctttcagaactgtgagcaatacatttctgttgcctgtaacttactcagcagcataaacaacttaggccggggctttaaaacaaattggtcactagtgagtaactgcgtgctaagtgtttcctcccaacagtgcctcatgattgacaaactggtcttgggcttacacgggtctatgacgtcctggagtacagactgccaagtcccttctctacagccagggcctttcttcacaggaaagtgactgcagtaagagccacctgccatgacctccaccccattaattacctctttgtctgatttgcaatatgcaagccttctccataccttccacctaaatgatgaattcacacttcagaccaaaaaaaaaaaggaaattatttgaaaaggccatttttctactaaccacccaggaatgtgtaggtgtagcatttaatagtgcctacaaagtccctccccgaggggaccttgcagtctagcaaggacagtgagaagtacacatttaaaaaaagatctactattatcctggctaacatggtgaaatcccgtctctactaaaaatacaaaaaattagccaggcgtggtggcaggtgcctgtagtcccagctactcgggaggctgaggcaggagaatggcgtgaacctaggaggcggagcttgcagtgagctgagatcgcaccactgcattccagcctgggcgacagagcgagactccatctcaaaaaacaaaaacaaaaaaaagatcaactatttatgggtccaataaaaactagctactgggccaggcgtggtggttcacacctataatcccagcactctaggaggctgaggtgggtggattgcttgaagccaggagttcgaaatgagcctggccaacatggcataaccccatgtctactcaaaaatacaaaaatcagccgggcatggtggcgggtgcctctaatcccagctactcaggaggctgaggcacaagactcaactgaacgcggggacgttgcagtgagctgagattgcgccactgcacccagcctgggcgacagagtgagactctgtctcaaaaaaacaaaaaaacaataacaaacaaaaaaaaaactacctactggccacctggaacaagggttaaccaacatatgaggcagccccttttattggtgagaaaaccgagatcagaaaaatgaatgaattactatccacatgctcccacaggaactgcagaagagcgcagcccagaacacaggaagccttcccattttaaaatcattcatcgagtgtaatcccagcacttcgggaggccaaggcaggcagatcacctgaggtcaggagttcaggaccaccctgaccaacatggagaaaccatatctctactaaaaatacaaaattagcggggcatggtggcgggcgcctgtaatcaatcacagctactcaggagggtgaggcaggagaatcgctttaacccggaaggcagaagttgcagtgagccgagatagcgtcattgcactctagcctgggcaacgagagcaaaactccatctcaaaaaaaaaaaaaaaaatcattcattgagtaacttttccattttttgccctatccatgtaatgtctgttgttttatttatttttcagggctctttaaatcagctcatctatatttttacttcaatggcttaatttaaaagggaaacattactcctaaattagtggaaaaactagtataatttgctataaatggaaggtaactagaaaaataaacagagagctattaatttctataaagtctgtggagttatagcttaaaatcatcttgtgagtcaccagtttgcatgtgacactttggaaaaggctgcaacagagaagttgagacctacgctttgcctggctggctggcaagactttgtaaaggaagaagaggaaaggtgtcccaggtgtgtgcacagcatggagaaacgtgcggaggtggatggagggcagagcgtggaaggcagagaggaaactgatacctacctgattaaatcaccgaagcacattcagttccgtgccatggatttaacatggactaacacactttggaaatactttcaaagcaaggtctgcaacaatagtgtttttgtaactcctagttaacaagaaaaacaacagatccaagcccccacggcggttccccagtgtttcccaatactgtcatctgattctgttttctgtcagggaaataaaatatcccatttcctccatgatggtgagttctgaatgcagctgtccacggtcaggggagatggagaggaaagaagccaaaaagcagcaggcaggcaaaggccagtgagaagatgttgactctggggccccgtccttcactactgtgtggttgcgggtgtgggtatggatgtggatatggatgcgtgtacagatgcaggtgtgggtgtgcatgcatgtgtgtgagagagaaaacctcctcctcctaggctcaccccaggccatcaaagagacacacataccttgcagaaagtcaacttctacactggttggggcaagtccagcccgtccgaatcccacagggaagggccaccatggcttctaccccagccgagctgacatccccaaacacagggactttcgtatgtgtgtccgactggccttgctccctgccagtggctgcctcttcaggggccagaaaccctgatcgtgtcaagcagtcctagaaaaaatgctcacccgctttctcagatgaagtgcagtagggctccctggcctgcacaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttttgggtttttttaagtggttaaattctcacaattttttgcctttgttcagtgcagggagacagtggtctgcaaaggtggtaacactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccaccacacccagctaattttttatagagatgagagggggtctcactgcattgcccaggctggtctcaaactctagggctcaagcgattggccagcctcagcctcccaaagtgctaggattacaggcgtgagccaccatgcccggcctcctgagaacctttaattgaacttgcagcattgcaattcagcccaagctccttgggtgcaggacttcacgttgctaaatccagggaagcctaccttggttacctgggaaaatggtgtgggaggttccttagatctctccctagccacctgctccttaaaaacatcacaagaggttgtgggaccacaaacccttgtctccgagaattccttcttctctccaaacttgccctattcacacattcccgatcttattttttcctgagtcctactttgtctgttccacattttttctttttctttttttttttttttgtgagacagagtcttgctctgtcacccaggctggagcgcagtgacgccatctcggctcactccagcttctgtctccagggttcaagtgattcttctcagcctcccgagtagctgtgattacaggcatgcgccaccacgtccggctaatttttgtatttttagtagaaacggggtttcgccatgttggccaggctggtcttgaactcctgacctcacccacctcggcctcccaaagtgctgggattataggcgtgagccaccgcacccggcccccgttctacattttaatggccctcaaatctgtcccctcctttcctttcccactttccctgtcccagttcaggcctttatcataactcccctgaactgaatgtccccttttctgattccttgcctctaggctcacttctgcaatccattccccacgaagcagccagagtgatcatctcaaactgatcttggaccatgctcttctgctcctcaaacatcttcagtggctccccattacctacacgatacatctgaagctccctgatgtggtctacagtacctgggcctgtgcctgccttatcagtcccatcccctgccaaggcctgctcctctcttttacatctgacactttggaaaaggctgcaacaaaggagaagttgaaacctacgctttgccgggctggctggaaagactttataaaggaagaggagccttgtgctccatgaatattgtatttcttgtgattttctgacaaggctcaatattttcatctctgttctctgtcgggaatggtctttcgtgtccccttatcctggtcattcgtggcctgctcacattcacccttttttttgggacggagtctcgctctgttgcccaggctggagtgcagttagttcaagcaatgctcccgtctcagcttccaaagtagctgggactacaggtgcccaccaccacaactaactaatttttgcatttttagtagagacgggctttcaccatattggtcaggctggtcttaaactcctgacttcaggtgatccacccacttcggcctcccaaagtgctgggattatcattcacccgttaaggtcatgctgtgggcaacagctcctccaggaagccttccaggagtgttctaggttatactgcccactcctacatgatcacagaactgataacactccgcaagggagaaacatcagaaatctatcttacaaaaattcaactataaacagtcaggagggaaaaaagagagagatagatggtgacacaaatcatttaaataatgtggaatcctgtgcaccacttgactctgtgagtatataccctgtgatgaacatcttgctatgatttctctctccatctagcccagagtcatttttctggaatctgtgagtttggggatctatggagagagaattctgggggtcttcgaacttgtacatacccgctgatgaacttgtacatattcataattattttcactaactctaactgaaatttagcatgaccttcaattatgaatataggcaacagactgcagtagtattagcaacacccgagactttgacaccaacagaaattgcagatattttcatgtcacattgctttggtggcagatgtctccaaatattgtttatacttgtcattacttcaaaattagggtagttattagacctgatgccaaatctactttaatgtgttaataaagaagcaaatgtattattactccacagttttctgatttttatatatactttgacggctgtacttcaatataaccactttcctttttaatcctctgcatttttttgcatttgaaaatattcagagaaggggagcataattttgaccagattccgaagggatttacaacacagagaaggtgacactatcctgctgtagacagtgagctcactggtggcagggcaccaggtccttcatcttccaatccccagcacctaaagcagtggttagtatacaataggaatttttaaaaaatgaactgagatattttatctatctatccttttttccctccttccttcttccttccttccctccttccgtcttttctcccttccatctgtgtatccatcatcatccatccatcacctatccatccatccattcatccatcctccatccatcatctatccctccatcatacatccatccatgatgcatccatcaccccttgtccacccatccctctatccatccacccatccctctatccatccacccattcgtccacccatctattatccactcatttatctacccactcacctctctatccatctgcccacccatccacccacccatcctgtatccactcatccctctatccatccgcccatccctccatccaacatatatccatccatctgattcaatctacagttctaacagttgacacctctgcagttggtttcccagatccagttctgcagctcaactggagactccctaagaaggaaaagtgactcactgtggaaagaggtgatactatttccttgtatggccgtgggcatgtcacagaatgtgcctgcagctcagctgtctttcacaggctgaacacagagctctgtctccagctgccaccacatgggctggggccccaagctcaggcagagcgccatgcctgtgttcagatcatttccttacccaggaacattttggttttctgctttcgaggtatcacagaatggttaaatcttaaagaacaatcgccaccattaccaattacacaaactgcacagaatggtagttaagagttctgcgtaggtccaaagaccagctccccactcactctctatatgaccttgggtgactcagttaaccctttcctctctgtgcctcagttttgctatttgaaagagggcataacaaccatacctcacttacacaggtttatggggagattaaagagaatcttccttatgggaagactgagttaatccatgcactgcacttagcacaggggctggcacatagtaaatgctcaacaatttttagccatcattatccatcatttcctccaaggaggcagacaatcagaacattaggacccagaatcctgaaaaatggagctatggaattcacaaataccccatgtaaaaaaatgcttagatccactcatatctaaaattcaaatcaaggcagcaagatactgtttttactcattggtttgtcgaagattataaagatggacaatcaccagtgcctttgaaagaggaaacaggaaaccacgtaaggctttgaccggagatgtgaagaaacctcctcataggacaatataaaatttaaaatgcacacaccctttgagccagtgatgttaaatctagtcacttaccctacagaggtacatacccaatcgagcaaaggtgtatttacaagaatggctaaaggcagcatagtttaaaatagggggaaaaaaaccaatctaaatgtctaccaacaggaaatcagtgaaatagatgatgaaatatttagtgcatttaattaatctttattgaacagctactacatcccagagactgtgacaggtgctgaaaacagaactggacaaaatagaaaagttaaaaataacgacgaagaatgatatgtgctgacaggagatgagtgataagatagagaggaaaagcaagttaccataaaatatgtttcagaaaatacatgtcataaaatatgatgttccatttcaaggaaacaggttcctgccaatatgcacatgaatacactcatgtacacatattaaattggtgcacaaagtaattgcagttcttgccattacttttaaatggcaaaaacttcaataacttgtgcaccgacataatacaagttaaaatgcaaaggaaaaatctggaagtagtagcaaaaaaaaaattaacagcagttatctctgaagaataggtataggaagtgatgtgcttttgaatcatttaattgttttcatcatgtgcttgtattgcattaatcctctgtaggtcccgtatgctctatctcctttcagaacacatccagcatcaaactatttcatttttaatttttgtgtacacggagtaggtataaactacttcttttggctttcactattaacactctggtccaaaccacccctgcatgtcccctaacagattacaacatccttccccctcacccatctccctgttcttgcccttgacccattacagtacattttcagcagggcagccaccaatcccattttccaaggcaaggccatgtcattcctctgtttaaaatcctctgaagacttcccagtgtggagtgaagcaaggacccttctaagtttcccaaggttctaatgatctagcttcacctccaccgcccctctctcccttactcatgctgttctagccacaccaggctctgctggcaaccaacacaccaaccacattctatctcagggcctttgccctggctgctcctgttccttcctctttctgcagagctccaccactcatgcttttgagatctttgctcaaacactgctgcatggaattgtctccaccaaaggaaaagggcaacctatctccaactggccttacctagcccacagtcctcccctgctttgctctcccatgctctcatcgccatctgacatgacatatcaacatgcatttctcggttgggcgtggcggctcatgcctgtaatcccagcactttgggaggccgagacaggcagatcccatgaggttgggagttcgagaccagccgggccaacatggtgaaaccccatctctactaaaagtacaaaaattagttgggcgaggtggcgcgtgcctgtaatcccagctacccaggaggctgaggcaggagaatcgctggaacccgggagacggaggttgcagtgagccgagatcgcaccattgcactccagcctgggcaacagagagagaccctgtctcaaaaaaaaacacatgcgtttctcatttactacctgtatagaatgtgtgctcagaagagtaagaatttctgtcatgttggctgttgtatctccagctcctaaaacagtatccagaacgtagtaggcactcaacacatatttattgaatacactgatcaatattatcacatgataatatgatatgctattgataattgcgatgatgaaaagcaaatccagaaaaaaacttcgagtccctaaagaaaaatgtttataaaaacaaaacataaattttgaaaaaacatgtttccagtcacagctgcccgcagagaacagggtggaacacccaacaagaaagtaacacgtaaacacctcacggccaacatggcacacagcagcctggttgtctcaggcagctgctctgcacacaggaccctttcacagagtccagggagtaaatgccagcaagggttgaacatgttacaacgtcagcccctgaagccacagactattttcgggtgtcaggcaaacccacaatctcctgtgacagccaaactactgcagatctgaaaaccgtctccctgcggtctttcaggggacaggcctccgggattgtgccacgaactcctcttgcttcacggcacccagtgcctgctgcatcaacagcgactcaggcataggtgggcttggggtctccatcccccagatgtgagctggaggccctacatccttttgtgcctcaaggttgtgctggcgttttagttttaaaatgaaaaaaaagaataatttgagacaggatctcgctctatcacccaggctggagtgcagtagcgcaatcacagctcactgcaacctccatctcctggcctcaagtgatcctcccacctcagcctcccgagtagctgggactaaaagcacgggccactacacgcagattatgttttatttttttgtagagatggtcttgttatattgttcgggctagtctcaaactcctggcctcaggcaatccttccaccttggcttcccaaagtgttggcattacaggcatgagccaccatacccagtgtgcttggctttttaaatgagaagaggaatcaagagagcgttcttccgtacctcatcacacccacagtgaaacacttggcacatgctatcttgtttgtaactccaggtcacatgaggtcacttggaagcaaaaaattaaagcccaatgacatttacagggaggcgttcaaccagcagacttcacctaaacgtcaccagctccgtctcattacagtcaacgggtgttgatttttacacattctctgctacccatacttggttaggaccgtggttttcagctcaggggtgcttttgctccccagagatattcggcaatgtccagagacatttgtgagacaactggaggagggagtgtcattaaaatctagtgtgtacatgccagagatgctgctaaacattctacaatgcagagaacagcctcacaacaaagaataatcctgtcccaggccgggtgcctgtaatcccagcactttgggaggccaaggcgggcggatcacgaggtcaggagattgagaccatcctggctaacacggtgaaaccccgtctctactaaaaaatacaaaaaaaaaaaaaaaattagccgggcgtggtggcgggcgcctgtagtcccagctactcaggaggctgaggcaggagaatggcacgaacccgggaggtggagcttgcagtgagccgagatcacgccattgcactccatcctgggtgacagaaggagactccatctcaaaaaaaaaaaaaaaagaataatcctgtcccaaatgtcagtagtgcccagatcaagtgaccccaggttagtcagtccacagggtaaacaaggttgccctggggaagggagtcccttaagcactgtagtgaggctggaggcaaaagaatggggttgataagatctggtacaccttggggcttttgagatgtgtcttcgcagccaactgtctaaggattctttttttttttttgagacaggtctctgtcacccaagctggagtgcagtgtggtgatcttggctcactgcaacctctgccttccggattcaagtgattctcctgcctcagcctcccgagtagctgggactacaagcatgcgccaccacgcttggctaatttttatatttttagtagagacggtgtttcaccatgttggccaggctggtctcaaactcctggcctcaagtgatctgcctgcctcagcctcccaaagttctaggattatacataggcgtgagccactgcgcccggcctaacacaggcaagtccactacctggccatgtctgaacataccccaggccagaaaaggagcttcctcagcctgtgggtggcagaggtgagacccaaggggccagctgttggcccgtttttatttccttagaagatgtctcagcctctgctactctgaccactcgtcatccaggcagttctgggcttcactcatgtggtgacgacacagttcatctctgaactgcacgcaggcaaaaaatgtcccagcttgctcttgagacaagcacctagtttggctgccaaaaacatcctggtatttcaactcgtgctgcttccctctctgtaaagaggaaaccagctacctaaacagaggaggaggaacattccagagaaggcacaaagcaaatccctgcagagaatgccaaagtctttgccctctctgtggcacagggatgcaggaggcagtgcatggaggcacggaggctggagagcctctgctccccaagcctgctacttccacaagagagaaaaggcagggggtgacgcagcttgcattcacaagtgacaagagggtgtctccagcttatcctcttagcagtcctcatggctgctttaactagttgggaagctgaagctcagaagctaaaagcctttctcaaaggtgatgcactgagcaagtgaaagagttgggattcaaacgtaggactatgaaagtaatactaagtgcttaggtgccaggcactgttctgttgcttaatgcacgttaacccatctgatcatcccaacaagtctaggaggtggctactgctgttacttcaaccgtttttatttattattattatttttgagagagagtctcgctctgtcacccatggtggagtacagtggcttgatctcggctcactgcaacctccatttcctgggttcaagtgattctcctgcctcagcctcccgagtagctgggattataggcgtgtgccaccacacgtggctaatttttgtatttttagtaaagacggggtctcgccatgttggtcaggctggtcttgaacacctgaccccaggtgatccacctgccttggcctcccaaagtgctgggattacaggcgtgagccaccgagcccggcctactctgaccattttttaaagaaactgaggcacaaagggatcgctggcgtgtggaaggtctcacagcagctaagtggtgagccagggggtctgctgcatagaccatgacctgcccccacgaggcccgttctcacctccccaaggggctgcttggggttaccaggtccagactgcccttgtccactttgcaggtgagaccctaggaggatccagagtcctgagtgtgcaggggacaggacaaacaatacccaggggactgtcactgaggtgaatgaacgcagcaggccaggtggggacttctatgaaccagtgaccccatcccgaggccccatgcaaaggggcagctggtggtcaccagtcatggacatccagcagctcagagtggttttacctatcagtttttcaaaaatcttccaaccccactcttcccctctctaaaaatttaaaaaatttaaaaatcttcctgaggccaaaggcaacccatgtgcaggtcagagatggccacgaggaggcccatggcacaactttgagtccagggccatgaaatgagaaagtcacctcctgctcccataactggtgcctgattctaactgggccagtgaacgtggagactggtcatctgaccaagaactctctttgagcccgttttatagctggaagttccttcttctagcattgagctggctgggtttttccttctcaggacaataaaactgcatttctgtcctcgaccccacccatctggcacctgcaccacagctaacttcagctttccacccagttctcttttgttcagtggaaaaaatgagctacagttcccagaagaaaatgagaacggggttattattaataagatactctttttcagaaaggcagttgaaggcagcggggaagatcacattgaggggggagccggggtagccccactgctactccctcctgcaggaccacctggtctggagaagcagctacgcgctggccctccctgttggctctcagaggtacaaaccagaggtggcggcatttctaagaaattagattcaaatactaggacagttaacatttcctggaggtgtgaccgagaaccaagaaaaagtgattttgtgaaggccttgcttgcaggcagaaataacctgtcttctctgtctgtctgtctgctctgggggctaccggaaggagctgaaggcctgtcccccgcctctccccaccccaccatgccctaggccttagtccctccccactgaagaatgcctttaccaacttgggacagacagaggagtatgaatgaatgagaatactccaagctgaccctgcctggggcatctcttctcacacatgtggcttctctggtgctttatttagcatgagactgtttagaatgtttatttttggctcagttttgggggacagttttcacaaatagaatgacagctatgatcttctctctaaaaaaagagctcgtacaatccaccgttgggcattcagtttcaagagcttcactgtcccatggtctccattctgggacctctcctccactggaagaccctctcctttaatcaaaacatgacacaagatgacagtgactccccatggcaagtcccattggcagtgctgagccagcgaggcgggggcccggtcagggtccctgaaggaaagagatgttactctccaaactgaagagactgtacaaagagattctttataaggaaaactaacaagggaggtgctatgcaccagggctggccacagccaggagctgtcaccaccctggggcctgaaggggagggagtggtgttcctggaccacggagacagtagctgcagccacgggagagggcagccccacagcagctgtggccttgctaggggtacagacacagccaacccatggaaaccctcatctcatctcttcccaccttcctatctcctaccagttcctctacttggccaaagcaaagaaaagtccttgctgatgaaacccatcaaggttagcctctggaggcccagagaagaaaggagaggggtggagagtggatctggggctggggcttgcgggggaagaagacacccaacatgtttcatcttgctaacacccaacatggagacagcaggaggaggcacaaagagggcgtgcggggctgtggatcttccacgctgagcctccacctcccactatccctgagcagcagaggaatcctggtttgctactgagctgctgaacgactgggcaaattgttcagcagctctgggtcctggtttccttccatgtcaagtataaagatggaacccaacaggccctaaggtatgggagtcacagccagcactgcagaagagggaggcctaagtgtgggccctctcaatgccactcccaaactctgtggtcttggaccagggactgagcctctccatgcctcagtgtcttcacttgcaaaggaagggtgtgagagcaccttcgccaagggatgttgttatgaggaaacgaggtcacgcatataaagtgttgagcaacatcccaggcacatagaaaacatgcaatcacccctccagctctcacgttccccaagtttgggccttgtctacggatttttacatccctcatacacctggacctccctcgtgctgctatcttttgtgaaagcaattttcttcattgaatgattccattaactagaacctgcaaacccagcctgaacattctagcatcgaaaccttctcttttaagctccgcagtatgcacagccctgccccaaaaccccatggagaagatcgcttcagcttcaaagatcttggtgcgtgtgctatttatgccaaatgttagtgatgcctcctcgctgagcctccggctcgtaagtcaatgcaaaaccagccacactgccttgttgctcagtggcagcaccacgggcttctgcctcagtgcttgaagtcaatggcggtgggggtgccctgagagaagatgcgtgtgctggaagggaaatgtgagtatggcctcctcaaggtgccactgctgtgctcaccgtctgcagggcaaaccgtgccacagcctggggcttcagctactcatcctagaatccactctgtatggacagatgtttccaagcccatgtgctctggattgccaagtgagtgatctatagcaagcaagatctaatctatatccacatctaatacatatcaaatctctgtatcaataaatagatatcaaatctctatgtcaattctttgtgtcaaatctgtctagatctaatctctaatctccttctatatcttattgatatctctacctatcttgtaacatagcagggaaggagacagatttcatttgtcacctggctctagtttagattctatcacctactgaccgtacaacttttaaaaggaaacttggtctctctggctttagcaggctcctctgtaaaatggggttaaggttagtaactcccagggttatttcccaatatatgaaagctaaactgctaggttcaaatcttgctgcctttgctacctgttgggcaagtaacttaacctctttgcgcctcagtttctcatctgtaaaacggggatgacagtaatacttcccataagagatagttgtgaaatgcaaatgagcaaatccatgtaaagaacttaatttagaagagggactcgcatgcagtataaatgcttaattcatgttacataaaagtgctaaatttatgaatgcatgtccaatgtacagttcccatctcaatgaaacatctattcagtgtatgtaatcattattgacaagagtgatcttttttttttagacggagtctcgctctgttgcccaggctggagtgcagtggtgcaatctcagctcactgcaagctccgcctcccgggttcacgtcattctcctacctcagcctcccaaatagctgggactacaggcgcccaccaccacacccggctaatttttttgtatttttagtagagacggggtttcactgtgttagccaaaatggtctcaatctcctgacctcgtgatccgcctgcctcggcctcccaaagtggtgggattacaggcgtgagccaccgtgcccagccaagagtgatcattttaagtgttctgagttaagggcttaaattcaaactttcaatgtcttcggtgaagtccactcccaacaagaaggggggaatggtgatctcaacacgatctattttttgaaatggtgcatgtggctgcactttggggaacttgctggctatttgcggaatgttgtatcacatcattcaccctgagtcatacagactagagaagatcccatggccaggagatcgcagatcctctctgagaatgactccatgctccaagtccagactccctgtccattgagccaagtctctgcccaggcagtggtctggctggtcacctccctgccccaccagggctaactagagaggcagcaaatcacagccagaggaaaagattatagtaaagcaatctggtccctccccaaactagccttctctgccccagagaggttcttctcccataaggaggctgacgggggaaaaaaacatatgggctgagaagcaatttagtctcaccatcctctcaacagatgctgggcaccataagaattaatgggctggagactcaggtaagagccattcagaagcttcccgattactccaaaaactgctctctgtggaggaaaaggttaatcgaagcccagagccggaagaacggagaggagacagcaattgtgttaatcccaggagaggggaagagcttcacaagaaagaagtttgcacaaacaagcctgtggtctatccctgaaagaagaaccaggcctaaatatcaagatatttgaaagatcttctccatcagtccagagaccttggcaaacccctctccaaaccccagccaagtagctggattaagaaaaaaaaattttttttttaactctgcacattctttgcactagtaagccataaatctcttaggaaaccatctcctgatgaggtttcttctcccataatgatccaacagaactcagtttttaaacacatgatgtacatgttcctgtgtatcatgggtcattgtgtacccagagtcagtcatgtcaatgcaggtctggacacattagaagataaatgtgtcggccaggcatgtggctcatgcctgtaatcccagcacttttggaggccaagatggatggatcacgaggtcatgagttcgagaacagcctggccgacatggtgaaactccatttctactaaaaatacaaaaattagccaggtgtggtgtcacatgcctgtaatcccagctactcaggagactgaggcaggagaattgctttaacctgggaggcagaggttgcagtgagccaagatcacaccattgcattccagcctgggtgacagagcaagactctgtctcaaaaaaaataaataagtaaataaataagatgaatgtgtcacaaccacagcctacagctggttaaagtctgaacttaaaccagaaagggtgatgtttgaacataaacaagagaacaaacaaggaagttgcaattgtatggctggaagtgtctttgtaaaataaactgtcctcagaacaaacgaagttactccagggtttcctaaccttgccactactgacatttgaggctttttttttgggggggggtgctttcctgtgcattatgggatgtttagtagcatccctgatctctacccactagatgccagtagcatccttcaccccgaagttataataatcacaaatgttgggccaggtacagtggctcatgcctgcaattccagcactttgcgaggctgaggcgggcggactgcttgagcccagaagttcaagaccagtcggggcaacatagcaaaatcccacctctacaaaaattacaaaaattagcatacacctgtagtcccaactacttgggaggctgaggtgggagcccaggaggttgaagctgcagtgaaccgagatggagtcactgcacttccagcctggttgacagagtgacagagcaagactctctcaaaaagaaaaggaaaaagtctcaggtgattgtcagatgtctccttggcggtcaaaattgacctagttgagaactactggtttatacttaagtttaagttcagctgaacatcagtcagctaattagctattagccaaatttcagacatcagcccccagctcagcataacattgctaagatctaaagttcctccagccttccaaatgctcacatcagacattagtttcactggatggccctgaatttaagcctctctccttctctcctacctccttagtccttttctttctcccctgcctgataaagtaattctttattcatcttgacattataatgacacaaaagcactgaaggagcaaatgccttaattgaatctaagaataactggcattatttttataggaacccagacatactacgcaaaaaattcagaactctgtcattgggtctttttgcaaggttaacttttaactgtaagctcctcagcacatctcacctcctgggctcagaagctcaaacctcatctctccagctcagattcccccactacctgggagattttacaaccacctccactctacccagtcactctcttacaaacatgtttgtcttatttccatccacttattactatctgaagttacggatgcatttattaatatctatttgtacctttttcatctgactctcctagaatggatgctttctaggcaaggaaacttctgtttttctctgctgtatctttcacagttagcacaaggccttgtctccacatggcccaatagtgatttacggaataaggaaatagatgaatccctttacatagatacaatttctcaagtattaacttccattcatatcactactcatttgctacaggagccctgttcacaatcatcatggccccagcatcatctttaaatcatgtgaatgtcattcccttccctctaacccaagttagctgatcaaagaaattcaagtatctggttggttttgaaaacccagaagttgggagttttcctcctgatgcctttgatctccaggtcctgagggggatctcagcataaacgaagacctgcttccctctaactctagctgagttcacaaatacccagattgacaaatcttgactcggcaaaagagctcctttattatatctcccaacgtatctcagtgtttgagtggaggccattagctaattgacagagagcctgttgagggtgggggaagtgagggcaggaggaggcagagacactagaattaaatggcaagagaccttgccagttggagtggattcagaaatgatcaactgtcttggggatcgatgagaaagaaagaataaagtaataaggattccaatgtatcaaaacactactgatgcgcagggacatgttttgcttttgttcttttaaaataaattttcattcgggtccattgcttaaaccattttacccccaagccctctgacaaactgtcaaagataactcactgcgcaaagcattgaatctttctatccatctacccatcatgcatctctctacccatatatctaagtacatctgtggatagttgtgctaggcactgtctatctgtccgtctgtctatctatggacgttggattgcatataccaagcccatttctccagctttgcctgaatgttagcaaatctttctactagtcaaggcaactttattttcttgcaaaataggaaagcagttgagaagataagattctgatgtcatgcaaccctgagtctaatgtgcatcaacactatctgcttcctgtgtgaccctgggcaagttacttagcctctctgacccttaggtacctcatgtggaaatcgggtatcacacaaacacctgtgtaaccatggcatttgaggataaaatgagagaagtcagttcttggcaaatggtaaatgttagtaagaatgaggataagaataatgccacctagccactcactgaactccttttttatttttttttcatttctaggtcacctgattcgctggcagtcaccatctggagaccagaggagcattcatcactgcaagtcagggcttccttggtgcctccccaggggcagcctgccgagccgggaagctgacaccagggatttaaaccttcctcggcttcctcattctattaatctggccgttaagcagagagtcctgctgatgccaacagatgcaaagctctgctgtgctaatggtaaagagcattagaggagtcctcagcagccaatcaatccatctcccccaactcagaacagctgcacagggacagattaaccaagcgatggctgaggaccgttgcaattcacacgagggagagagggatgcgtgaaggaaagggcccctgcacagccgtgttctaatgcaggccaggtcttggacaagcaaagcggctgatgcattgtgcaaggacacagctctcagtgaaatctaacaggcaggctaacctgtgacagctgggctcaagatggagcaggcgatgctgtccttagaagccaagtgcactgggagaaaagcgggaactgacccagggctcagggtacatctgtcacctaacctctgcagagttaattcttccaagcttggccacatctgccatcttgttcatggcatatgggtaacatttgaggcactacttcctgccagaaagggacctgacccccttgtctgacctgcctgcaggcagctgaacaggatcccatcattcacctcacaatgggctgaggccagcacaaagtcagatctggccacgggcttgtgccaacagtcacaaagaaacatttgcactttggttgggttccaacatctctttaacatgggaaatcagaactcggggagcgagaacaatattcccaggctccccaaagacagggaaccaaatgagactgatggagcatcgtttgcagacaaattgaagctcttccccaatggcatagcacaaatgctgagagtctaccttgtgccattgctggttgcagatggaggttcaggtcccttgggctaacagattggactttaagagtcgccactgtgtaaggagctgctgctggaagcctcaggtgctggccaaagccactggtctgcaactcctctttcccatgagggttttgaagggctgatggggtggtgtccagagtgaaggatacaggaaggtcaaagacagaaccatccagggattctgctgttccactcccaggagataagatttgacttccagagttccggacacagatgttcgcccatgggttttcataagtttaatagggtatccttctggggaaggataaggaaaagaaggaccatcattttaaaaacacaccgtggaagttctctcatagtccctggggtagactgggtagagacacgtttcccaaagggtagcacacacatctctgataggaagtttaggtgacatcagagggtgcgtacaggaacaatattttcacagtttaatatctattttaatgttgtgcaaaaaaatatataactagcccttcaaacttgtggttccatgaatattattgcttgagacagtgtttctcaatctcaacaccattagtatttagggctggatcattcttttttgagaccgagtctcactctgtcacccaggctggagtgcagtggctcaatcttggctcactgcagcctctacctcctgggtccatgtgattctcctgcctcagcctcccaagtagctgggattacaggcacatactaccatgcctggctatgttttgtattttttttcagtagagatggggtttcaccatgttggccaggctggtctcgaactcctagcctcaagtgatctgcctacctcagccccccaaagtgctgggatacaggcgttagccaccgtgccaggcccaggaccagataattctttccagtggggagctggcctgtgtgttgtaggatatttaacagcaacctgggtctccacctactagatgccagttgtaaaccccccaaccagatgagaccaccaccaaatgtcttcagacgttgccaaataaccactgggaatcaaaaccaccccccggtttagaaccattagattaaggtaagtctatttctgaaagcaaagtgagttatgttaaggaaaaatgtatttttaggtgactttatagaatagatgaaatttacataaggcaaaggtggtcaaggtgataaggacagacaaaaccaagccagaggacagccaaacaggcagaggaaaccgaatccttttcctcctcagagctgcaccttctatacttccctgccggccctggcgcctggtcagccctggggcccccgtggctatacctgtgtgccagagaatgcaaggacagaaaagcacaaggaaactgtgaagatctgctggccttccccatcagggaggaagcaaggaaggtctcctcattcctcttaggagaacccaagcagagatgccaaggagagggcaaggacccaaggtggaggaggcaaaggccaggggagcaggtggtcttttccagtccaccccagaaacccttgaaatcgctgagctgtcattcagccttgaaacgttcgaacaggtttgactgtgtctgacacttgcaagctattcactgtggggctctgaacgaggcctgtcctgtctgcctactctctttactgtcagccaaacccaaagagctaaggaaatgattaatccaaagataagaaacgtccccttcagatccagcaggaaaagtaacagttctattggtttaaaaagctgccacttgccggacgcagtggctcatgcctgtaatcccagcactttgggaggccaaggtgagcggatcacaaggtcaggagatcaagaccatcctggctaacacggtgaaacctcgtctctagaaaaaatattaaaaaattagccgggcgtggcagcgtgcgcctgtagtcccagctgctggggaggctgagacagaagaatggcgtgaacccgggaggcagagcttgcagtaagccgagatcatgccactgcactccagcctgggcaacagagactcggtctcaaaaaaaaaaaaaaaaaaaaaaaaaaacgctaccactcacaagcacttagcacgtaccccggactttataaacatcatttcctgtgaccctcaaccacaactctgcaaggtgggcactatcactgggatgacgtttcagatgcgaagacactggcttagacattatgtggccccatgaacactgcagggctagaagacacagaggtggaattccacctggctctgttgaactccaaggcctatactcatagctgctgcactgtcctagctcccaggaaggcagaaagcagacagtcagggccgtgccctcccttacaagacccgctggtcatcctcctccccacacggaaatgccactgcaatcacaattcctcagaatggcctaacacgcaagcagatgaaagggtgcaacttccttccatatgctgccctcactgccaaggaataaaagtcctccaagttcaggcatcaaagagtagcatcttcccacttcatggctctcctctgtctcctctctcctttgcatgaacctccgcatgatggttgggcaggagcgaaggacagacgaaaactcaaaagaaatgattatggttctcgccacaggtgggaggggcaccagacacctgggtgcgaatgtgcacccatgcacacccacaccattgcacacacgtgtacactatatgccagtgtgtatacatacatgtgcaggcacacacacatccaaatgggaccaggggcagccatgggcctgtccagcctttcagagccacgggacaagtccccttgagagctggaatactaaggctgagataagtggccaagacaggaaagatacttacctgagtctccagggtgatgagcggacttgggtgtggatcctgtaggatgaaaggagaaaatgcacgtgaggagtgaaaaaaagttaacttactaccccagcatctttttctttctttcctttttttttttttttaagagacagggtctcgctttgttgcccaggctggagagcagtggcatgatcatagctcactcactgcagcctcgacctccagggctcaagtgatcctcccacctcagcctcccaagtagctatgactacaggcatgcactatcatgccaggcttttttaaaaaattatttttgtagagatggggtctcgctatgtttcccaggctgttctccaacactttggcctcaatgatcctcccacttcggccacccaacgtgctgggattataagcatgagccaccacgccaagctcccagcatcattttcaaacaaagcttgatttccccagtggtcaagccaccccacggggagggcagcccaacctgtgtcctccattctacagagacatcaggacagcttggcccagtctgcaggccgccccaacacttcctctcacgcacaagtgatgaaagaggctcaagtttttatgaaggaaatgcccacatggagatcacacaaaacaacaaaatgtaaagaaaaaagaaacaaggcacccttgccaaagagctcaacgtgtatccaaaccctctataaggagagtttggctccgtaagaggattaggaataaaccagaaagaatataaagtcctgactaggaacaaggccatcatcaatttgtgtctgatcttggaaagaacaagggaaggaatgagagcgagcagcttaatttctggtttgaggagcacattccatggtctggggaaggtctttttttaggatagagaaggccagagaaatgtcctattcattcactctgtacaaaagccgattgactgggaatgcttggtggtactgtctcgggtcattaagcatgaaccctttgggttggaggagagacagggagggtacaggaggaggaaaagactgatgggaggagttggtggtgtccagtgagtggtttccaaagaaaacaggaaacccagcacatgaaggctatttctgtctataccacgtctgctctgaacttaatcatcttggatttataattctgggaaaaacaacctcaagcttcctctgatagagaatgggcatgattttagggccctgaagtacacatccagtttgaagctttgctttgtcttagcagattttccaccacggggttttaggaagccatgcaaattagcaccagcccattgtcccatactgtgagcaagaaggaaatgcagggaaattggaactttctaaaccccttctctaggtgagctgccattcactgtcttgatgactgttctacggtatctttgtaatgatgcccaattctgaggagtgtaagaggcacgatctcagaaatacggtgagctctgctcagctctgtcctttaggaagaggaattcgtcgtcccccaactccaattctgagtccaactcccagtaattctccattggtgtaactgaaaggaaactgccaagagaacatcccactctaattctcacattcccccaggcattgagtcttcctcatacccaagaaaacatggaggggaatatgttctccccgtctccccacattgcagccttgacctataaaggaatctggggaagtcatgaaggagctgttttgggcctgtctcttcaaatccttactgattccttcccaggggtgaagaagtggcagctaggattggtaaaacccgacattcatagagcaactttcttttgatcaggcaggttttgtatcactcgcatgcagaaagagtctactctgtacttcctgtttccctgtgttggggcaggacccatttttgtctttgggaagcaagaccatcctcctggtctgtgggtggcagcatgagtcagacctggtacgagcttagtgggcgagagcatgcaacatctgctgttcaggtcagagtagtctgtgtctgtctgtctgtccattcagatcttaccacctcgattttgattataagataagaagctgcatctcagcctcaaaattagcctcaatctccaagccaagtgctagcaaagcaccagactggggtgttgggtgcatgcccagattaattaagctgtacttcacagaccatttggctattgtctgagacttaatgcttcattgcttagaatctccaagaggttgaagaggggagaatgccatcctgacccctaaaagcagctccaatggacaagactttccttgggaagtcacaggaaatctctgtcaactgtgttgacaaaatcaaaagcctgatctctagacacagtgaagcatcagctctctatttgatgttccaaaatcagagaccttatcagtgcatggtcagggatccaagattaagaagattctggaaagcaaaagcacaaatgctatctatttagcatcttcattaactaactgggaagaagataaagtcctcacaaggggccacatcattaatacttgggtttcacttgccagcatcattatgctctcctccctctgcacacactggaaatggaagactctccctaaagagcctcagtccagaggattcaaggtatgactatatatctgtgaggtctcgctttcagcaacatcctccttaattggaaaggctaacgaagtggaaccaggtcaatgatgctgtctgcctaatccatcctatctgtctaaattgggactctttggtttacagtagagtaaattcctgtccatcagaggaaagcctcctggagaccaaaggggaatttgcaatgtgcgtgcacgctacagtggagtgcttttagaatcttaatgccggtaccagtaaccatggaaccgcctacaacaaggaaagccctttcctatcatctattgcaatggctcagttggggaagtcaaatggggaaccaggtgcactgaattggtggccctcattcgtcacagctcctagatccatgccctctggtcatgtgactcgacagttctttactgtgtgcttctgcagcccttaagcttgggtttgcccatttgactgctttgcccaatgggaggttagtagatgtggcataagcagaagcttgaaatatgcttaggtgatcaagtgtggcctactgtgtttttgccattgccacaagagatcatgtccccagtaccttgctggtccaaggaggatgccagacacgtgaaacaaacctgtacacaatctacagcgtgcagccacgccccgcctagatcagccgaccccctgccaacacagagaaaatatatgcttgttgtttcaagccactgagttttgaagtcatttgttatacagcattattgtggcagtaactgatatactttctaaacactgacctcgatagatcaaaaagtgttgtcacaaacactcacagactcagaacctaaataatacatgctctttctctaagtctgcaaatgcatcccaggaacctgaaattactacagctaacagcgatcatttatagagggcctcctaggtgccaggccctgtgtgctagctctattattacatcaagcaaggaaataagtgaccatcaggatcttgcatgcctctgaattagccttcaatcctgtgtgcccaatataccagtccttctgaatttattatttagataccaacacaacatgacaggaaatgattactcagaatccttttgcctgaaaatacatacagttttcattcctttggtttattcttaactttgtcctatgggcatattacttgactgaggttctgaacagttgaatactagcaataaatgacatttgttaagttctcactatgttccaggcactgggcttaacttctatgcgtgtatcatttcgtttacccctgtaataaccctaagaggtagatactatcattatcactatcattagtatagagatggagaaactgatgaccagagagactggtaacctgtccgagtcacacagatgctgttgaaagcctggatctgatcccagcatcttacactggagaacactgggttccactctttcacaagagctctgctggaaaatatattattactttagacaaaataatcctacaatttttggataatgtctatcaaaatcaagaatacttacagcaaataagcagtaccaccttaacaaataccgtaatctttttttttttaccatctgtcttttttaaaaaggtagcggacatggttgatagaaattagcacacatatcatgactagaaacaaaacagtcactttgccacagcaaggaaccatgtaaagttagctaaatcaatccacacgtgtttactaagttccgattcagtagctagctctatgcgtggcaggcaccatgagggagacagaaatgagtttaaagtgactctgtgtacactgctattcccaaaggtaactgtttaaataagaggcaggagcctgattacaggtcttagagcaatgaaacttgtctacacctcaaaagtcttgcttgtaagaccaagaagccaggctcaaggccaaaggcttaattttaacaagcaattaagccccaacaaagaaagtagagagaggaggaggactttgttcgttatcattccacacatacatcaaacctatctggctctcctggcggattctgagccctgagctaagcctcagccattggaaagcatgttctcttcctttgctttgaggacattcagaagacagtgcttgttctttggtgttaggcaatgacattggtgtagagataatgacactggaactcacgccttcagagccaggtatctccgtgaagcccaccaaatcaacaacatagacaatggacatttacatgctaccttcttccacagacgctcccagggaacacttcagaaggctggcttggtgccttctctccgccaagagccctctaattaaggccagaactgggaatcttccaccatcaaaagatggtgtctcactgtcactcatcatccaaccaccagataacttggaaaatctaagaaactcttcttgggattgcagatcacagcgaatgaaaactcactcatgactcgagcctgctggagaatgtccagctctagccaagtctgaatgaccagccagaaacctaaagggacactgtcacttagctgcaggcctagtagtgcaggacaaagatgaattattcagtgggaaaagagggcaggtttaggggtcgccccagagttcaaaccatacataaccactgtattcatttgctagggctgctataataatacacaggtgaggtggcttaaacaacagagatttatcctttcacagttctggaggttgaaagtccaaggtcaaggtgtctgcaggtctggcttctgaggtctgattctcctcctagcctgtagagatggtggccttctcactgtttcctcacacagccttttctctatgcatcccgggtatctatgtgtcaaaatttcctcttctttttggggtgccagaaatggagtctcattctgtggcccagactgcagtgcagtggcacaatccaagctcactgcaacctccgcctcctgggttcaagcgattcccctgcctcagcctcccgagtagctgggattacaagtggttgccaccacgcccagctaattttttagaatatttttagtagagatggggtttcaccatgttagccaggctggtcttgaactcctgacctcaagtgatccacctgcttcagcctcccaaagtgccgggattacagctgtgcaccatcatgccaggctaatttttgtatttttagtagagatgggcttttgccgtgttggccaggctggtctcgaactcctgacctcaggtgatctgcctgcctcaccctcccaaagtgctgggattaaaggcatgagccaccaggcctggctcaaatttccttttcttataaacaaaccagtcagattggatgagggccccattaatttaatgcaatcacctcagtaaaggccttatctccaaatagtcacattttgaggtattgggggaggaagggtttcaacatatgaaattagggtgggggtacaattcagtccataacaaccacctagcaccacttgcgaccttgggcaaagtccttagcttctgtgagctttatttttctcactgacccccacgtaaacaggtaggattatacttgccaacagagctactgtaacaaagtggaaaacagattttctgggacctttttgtaagggacactattaataattatacaagcttaacaggtataaacccagactgtcccaggaaaccctaagataggctcctctttgtcttgaacacagcataccactgacatcatgagttgtcgtgaacattaaataaaaataaatactgtacatagttacaacctcagaaatgatcttctctttgatttcttcctccaggcttacaaaggctgagacatatccctctatactcaaccctactaaaccacaagtcttctgaactgcaagttaccgtagatacgagtgcaacctatgtcacgtgacggcagtgaactgagcaaatttagctaattcgttttgaatgcttactttatgccaagcatacgaaattcctgcaacgctgccaagggaggtatcatgatccccattttatagatcagataactgatactctcagagaataatttgctcaaaaacacagggctaatcaggaatggagccaggagcagtaagcaagtttgtaagttgccagaaactagtcctttaaccgatatcctggtgttaatcaaaagtatgaacttactgaatcagaatctctgggcaagggtccaaggaatctacattgttatgaaacacccttgggggattcttacgtacgctgaaccggagagactttacatgatacctaaactctaccatgtgtaatgcaagactgaaaaagcttccaaactgacaaagaatacgattcctgcctctgatccccagccagccatcaagtgtcggatgcatgcgtgaaactcttaagagcgttggtgttcacgctctgcacccccaagaaatttccaggacgggtgcaaagtgttcccttctccccactttggtgaagagatttgccttgccctaaaaaacctggctaccaccctccactttccagcatttcctcctcagggaagtgggactctttttcaactcctccttcttagggtctcattgcagcaaccaaggtgttgcataacggggctttctcttcagatgtccccatgggatttcacactggctcctaagacgaaggctgggcacgtgcagggcaggcggcatggggtgatgagggagggatgccagtgatacagaggtgtccttgttctctaaaaaagactgcatttggaatgtgaatgcaggccagaatcacacagccctcaccttgttggaaaatgtgaactcaccttcaaatagggctcaggggagaaaacagaaaccccacagagagaacaaggggattctcaatgttttacagaaacgttggcagttaaaactgggtgtattgcgcgctctctttctctcttttgtattaaaagcttaaaaagctggtctttctgctatcctactttcattctacatttttttagcccaggacccagaaatgagcagtagaaccttaaaatgaagcttaggcccttggagatggcaattcatcacccacagccttggaagatagagaaaccacagactcatggaaacttgggaattatcttaatgcttctccagcttggtatgtgtatccttgagcacaaatggttatcaaaaatctaaactcctgtatttaatactttgttctgtgtgtgcctcaagaggttttgtaattctttaaaaagtacacagaattaccatcttagaattacaaggttttgaagaaacctacctgaaaagattagaggcttgagctacagagtgttaagacaagaatgcccaactggtggcctgtggatgcttcaagctggtttgctttttttttttttttttggcctgcagccttgatgaaatacttgaaatcattcattgccaatgttttaaaaccaggatacttcacatgcaaatctagatttctcacgtctcctttaagaacagaagatttagcaacactggatgtgtattcttgcaagaaaacagctccagactgagtagctggcctggctactgcaagcaacagaatttatcacccccatattaatgcaaattgcctaaggtcacatagctagtcaatattgacaataatcaaaataccagctaacattgttctcacactgaatgccaggtattactgtaaggggtttgtaaatattatcttatttaattcttacaactgtctgggtgttgtggctcaagcctgtaatccgtggaggccaaggctgacggatcacttgcggtcaggaggtcgagactggcctgaccaatatggtgaaaccccatctctactaaaaatataaaacttagctgggcgtgttggtgcatacctgtagtcccagctacccaggaggctgaggcacgagaacagcttgaaccctggcggcagaggctgcagtgagccaagatagtgccactgcactccagcctgggtgacagactgggaccgtgtcttaaaacaaacaaacaaacaaacaaaccaaccttacaagaactccaggaggcaggcaccaaaagccccattttacagatggtgtaattgaggctcaaaggagaagtaattttttcaaactcattcattagtgggtggtgaagccaggatttgaaacagggcatccttttggaccactaagctaccctgcttcccagtggtacaaccacatcttgaactggaatcattaaaccacagttcctggttctatcagcatctggcactaagaagccataaggagcactgaattggatcagatgctcctcatactagatgttctcatttccttgctgcgagtcttcaggtcgactactttgctttttccagtggttaatggtaataatcatcaccatgatcctctcacactcattgtggagcactgactgagatgttctaccagagcccggctcagtcctgacagagtgggtgggccaccaatgttagttcctcttagaagacaattggcgacactttacagtgttttgcttttcacagctcagaggcatctcagaccataaacaagacctgccacgtgccaagaaggcagccgttacccgacatggcccagacaggaagtgctggctaaatcccaccatgccgcaaatctttctaaaggtggccacccaggctgtgtttgaacacacatcctcctggagctgggaacacacgccacatctataattcatcccgataattagcttttcccaggcacaggccgcagcacctatcaattttgcacccacttgctgtggtcaccaagatggcaggtggcccaactggaaccaatactgccaagtgtcccacagacattgtctggagttccaatgatactatgtgacttctgggactgctgggtgagatctctgttccacaggaaaatagttcatatttgagctccagaatccaaaatcgtgagttcaagaaaagcacttagaggtgcagaccagttatgcagcgaattcacaataagttgcccgaggcagctgttactaagcagtccacctggcctcaaattctcaatacggcccgaggagcagatattattaatagattccagtttccctagatgtccgtccctgacctgaatcaaacccatcactgtttggtgaggcatgggagatccaggaggaaaggcctatttcctaagggccacacacagtttggattaaaattcagtgtagaatgtcagttttttgataccaaatctggagttcatcccattttgccaaaataaatttctatgcacatccctccctgcttttcttcacttcctcctcttttgctccttcacaagagcctctgaccaggacatctattgtcgaagatacaggaaaactgtgattcagcagtgcttcgcgtctggaatgactccaagaggccacacacagaactgccgacacaaaccacggggggcggaaaaaacgatcccaggaggtggggagtggagagctttgcagtcccaggctacagctcgggatgtagagctgccttcctaggacagaagagagacgatgagaacacctggctggaaggtggccctgcaggggacggatgggccttctacatttagagtcaggatggagtcagaaagcttcagcaggggagggactctgcctgcagcctgtcccctcaacctcctctaatatttcttaatgaaacgatagtgacaatgaagatgacagccttgatgacagcgcccagtagaccgctatcattggttaagtccttatgagataccataattcaccatttatgagcattacttcaataaacccacattctatcctcatgaagtggctgttcccagaaggccataaagactggatagatagattttttttttttttttggtttttactttaaaaaaaaaaaacgacagggtcttgctctgctgcccagattggagtgcagtgatgtaatcatggctcaccacagccttgaacttctgggctcaagcaatccttccacctcaccctcccaagtagctgggactacaggcctgtgccaccacgcctggctaatatttcattttttgtagagatggggtcttcctatgttgcccaggctggtcttgaactcctggtctcaagtgatcctactgccttggcctcccgaattgctggaattgcaggcaagagtcagtgtgcccagtttgctttttctcttgatgacattaagtatttccttgttcctggattatgaataccctgtagtactgttcctaatttatataggaggaaactgaggctcagagagtttcaaagacttggttgaaagccacagagccaggcccatttaaccttaatatcttcagagaggtttaaaaaaaaaaagaaaaaaaggtaaccaaaatgcttggatgtggtatggtgtgatctgcatggtgcacaaaaatacttctttttttttttttttttttagatggagttttgcttgtcacgcaagctagagtgcagtggcgtgatctcggctcactgcaacctccacctcccgggttcaagcgattctcctgcctcagactcctgaggagctgggattacaggcacatgctactaagcctggctaatttttgaacaatactttttttaaaattaggtgccagcatttaaaatttagggtgaaatcatgatattctgatttgtggcttttcgtgaaatgtggaaagatctgacccactgggtaggcaggtccacttaaggcaggcacatccccttctgtttgccacaaccccaccctgcccacctgggctgagccctgaaagcatctaagtttatgaccttcctatctgttcaccaccataccttacccctcccccacaaaggaaggtaccatgttaccccatgaacatgactccaaccctcacccgccaacctcaagaagaaaaattcgggatcccgtgacttcacagcagaaacagaaaaactcaaataatccatcaggaagttgagcactgaggttaatacacacaggaccatcttcctctagctcaacagtcttgacttttcagggccgtgacccagaagggaggtgcccgtgcagaaggcagaacaggaagaggttcttagcacccactgttttctcttcctgcacagccgccttgggcagctgcctgtgaacagcctggctgtttttctcctagctctctcggaaggaagtgctctcatcacccacgacaacagagttggcccgaggagccaaaaacgtgcaaaggggctccaagcccagctctccttctgttcggggcagcctcagagacaggaagatgggaagaaagtatggcctgggatagaacatcctgcgagacccttacaaagccccagctgtgggggaagggaacaacaggagggggccagaggaagggggtccaggtcacaccaattttatacaatgagctcctttcatccgtgaatagaggactctccttaactctgtctcaatggctttgtttctgaaacgatcaattctacacccagaaagccaaatttgccagacctcatgccaaggtcaggcaagagcctgagatcccccaagcaagttgataatcaacacgcaggagacgacgctgtgctaagtcccatttggcggatccaaagcttacaacgatccgctttcatttctacgccttctgcagtggggcggggttgggggaccctcgctcacatgcatgccacgcttggtggaactgtaggctgtattcaggagagtaagtgttactttcccagggacttcattgagacatctgcggggagggcaggatgagaaagagctggagaaacaagatgcaaggtaaagtgtgtggtctcacactgaacacgttcatgaagtggtgggaagcaaccctagtgactcagcagtggcctctgtttagccagcactttgagaacacgatcttcatgggctgactgcagaggtggccaacagaaactggaatctacaagcagtattcagctcaggcatagtttgttcagcctgcacaatgttttaaaaagaacaacaaaaacctacataggatgccaatacttcacattcaggaggtttcccataaaactgcaaagttctggcattttttggaaaaatcagaagacctagctacacaaatccagcattttcctaaggcactgcctttctggcactggaaagcagctatctcccttagaagggtcacaggccctcctgcttgccacagtccccgccccagacacatgtccttcacttacggctgccagtgtggctgctgtgggcattggtgtttgtaatctctggtttagtggatcctaagctaagcccagcactttcagctggaggacctgaggttagagagaaggacgggatatgaaccatagacaggttgtaaagtaacgtggctgcaaagtccaagaataatttaactcaagaagcacctatgaatgcacacccaggaatacaaggcagagagcaaagttgactcccatggataggggtgagagtcctgtcttctcatcagcccctgctacatacttttgacaacttgtcccacttccccaggaccagggactatcttctttgtttttatgcttaatgaagtcctaagactgccacatagaaagcacttggtaaattcttgctgaaccaaaatcaacggaaacccaattcatgttataggtggaatctgagagatgtatgctgagaactcagccaacttctgagctgtaggatgttttcctgactgtaagtcaaggcaagtcctccctataaagaagagtttggggtataaatgacacagcagaaggagacaagctcaacctactgattggctaatgtctgagatgaggaagcagaaaggttagtctttataggatatgtagcatatctgatgagctatggtctgttaggaaggtactatacgtactaatttcataaaattgaagtatgttccaacttatcaaaggatgcaaaaactccacagaaggaaggaaggacctcatgtggtggcaggtgcagcatattttactgcaacctttctaggtctaaaaaggtaaaatgaggtttatcacatctgcttctgctgtgtatagccatggctagttttctccagctctgtttattaagagacagagagaaagaaagagagagtgtatgtgtgtgaatatgcatgtgtgtacacacacatatgtgagcatccacatgcacatacaggtatgcatgtgtggtctctttcattcaacacccccccaaaaaaagttgctatgggatctgtagattttgtttgctgagtatccctaattttggaattccctctgttctaagttgccccattcttggtactaatttcaaatggctgtgggggaggggaggctagcttcagacaagattccactaagagttttacttctgagctgggatagaagcaggaaagaataacaggaaaaacatgcagcatcccatctctgcactttgcatttagttataattattcacgcaggagcatctttaaacaccaaacgagggaaatattacagttgttctgatttcacatgctaactgtgtttacatgctaacagcatttctcagggacaattatcttattactagtgcactaatcttttcaatcttttcaacacattttacagctgcagacttcaaaaattaaggctaattaagaccttgctttcagcaggtacagtaaactactcacattccaacatggtaaaagaaaatcagtttaggggaaagggtgttagaggggcacagtgtcaatggcagacagaatacattagatagcttccatcagtgtgaggactacaactctcccaatgctaatgttcaagaacaagttccattaatggtaaggcctgtcgaattcaggaccaaggacagctggtctggcccatttttaagagaaagtgggtattttgcattcaattatccgtttccattcattatcttcttccgtgtgacttcagcatagaatagtggctaagaacatggaaacttgtatcagagtctctgtgtacaaatgccggctcaattattttccgtttgaacttgagcaaattacttgagatcttggtgcctcagtttcctcatatgcgaagtaggaataataataatgacatatacctacttcccaggcctgttattaggattcaccgaatatctgtaaagcacttacaacaatgtctgatcataataaatcatcaaatacgtatttcttttaaaaagtgtggtctataaggactaacaacaaacatctgttttctaacacgttcttgacctcacatgtactcactgcattatgggccatttgagggctgctaatatataatcatagctatatttattgtgcctgttagcaatacattctccagttacttgccctgctatctcattagctgccatataaaaccagcaccttggatcatccaatattattttttgttttgtttcgttttaaatcacagagaagcagaatgctctctgaagggctgttgttggaatccatattcacagtccagcttctcagatcccaagcaaaagctctggcatcccaagttgtggcgtctgagaaaccagtaatcagcgtctacagtgctcgggccactgacgttcatcaggcacctactatgtgcctcaacctaggcttgagaggctgctttttgaatgctcacaccaactctgtggggaagataatgctggccccattttatagatgaggaaactgaggcttcagacaattctacagccacaaaacttgtgaataaaacaaagttaccgtgtagtacacgtgtttcattctctccagccacacacttttaagccagctggcggaatttctcaagatgatgaatactattatttttactagctgtagaactcataataatggttgttaccatcaacaccaacatacagcatgtgccaggcactgacatattttactcacttaattctgacaactgcccttaaggaatggactcctattagcctctatttacagatgagggacctgggctcagagaggttatgccatgtgcccaaagtcacacagctgcacagtgttggagctagaatttgatcaaattcaggagatccagcttgagaacactgctcgtgaacactattctccagcctctcgtaatacctataaaattcaacaactgtctccttttcaatggacacataaggtatctttaacaagatagctacagggagtattgattccatcatcttatatcaaacaactgattgcaaaattggtgatttagttagatttgtgataaatgctgccaaaggggagaaggtagggacagaaaacacaggaacttcatccaggagagaagatcagaaaggttctttcagaaagggagaattaaactggctgccaaagaatgagtgagaatcaacttgtccaaggtagaggagaggacaagcattttaggcagaaggagaagcatgaataaaggctctgtggtgggaaggcactcataattttgaggacacaaagaaaggaagtctgaatctagaatcaacattgagaaggtgagtagcatatgataaagtggtaggatttggtgtaggggccaccaggtcagggagtccctttgggtgctaggaaggagcttgagtcttatccaaagagcaacagggagtcactgccaaagttcctgtgtagattgattggaatcttcatcaggatcagccttcactcctactccctagattataatatttggcttttacataatcagatccaaaggtacttctgaaaaccaactcagtgaatcagcacactgaagattttcaaaataagtctcaaataattcctattccccatttttagggatcatgatataacccacacggtctaagacattatgttgctactaccatgccgtactaattattcaaccctcagtattgttattacagacagaaaaaaaaaaacaagaggtgatatcttgtaacatgaaagtcaaaaaaaatcttttttctgtctaaaatagaaggacaaaaaaaatcaatctaggttagaaaacatcaatttgcaagagttctatggctgaggaaaatggcatgagtatttgtaggctgaaacaaatgagcagctaaaacatccccccaccacctcccacacataaccaaatgggacagactacttctggcatgtttccatttactcacacctacaatgtgctaggtgctatggtttatttcaaccccataaccagtgtgaccaagcatcccagcttgcctgggactgaggatatgggacgttcagcactaaaaatcaggcatatcccagaccaactaggacacactggtggctcaacctgcaacaaccacagctattaatataaggcagacacaggctcagagaggtggagacacttgttaatgtcacacagcaggtaaggggcagagaccaagattcaagttccagtccgtgcaacttcaaatcctataataacatttcttaggcacttattatggactaggtagtgctttaagcccatttagaagcattataagcattaattaatcctcgcaacatctctatgaagtacatactattctgggtcttgttttatagatggaaaattcaaagctaagattagctaataactcacccaaaatcccccagccaagagggacctggctttagtgcctatattgttaaccggcccatccaacagacccctgggcaaaaaccctgtcgcaatgcaaaaaaaaaaataaaattttagctgtttcttgttcaagataacatttaaaacacacacacacacacacacacagaaaagattagacgagaggtctggaaaaacaagttgctctgagtcttacagccaccacaaagcaggaattgctagtggctgctgatttacaaggctctctggtgaattacagaaagggaaatacagtcagatttgataaggctggtcaagttcggtgctcaagagcagtccatgatccagagaggccgggaacatgctcctgggccctcgtgcccatcagatcaatccccaccggccaggtggatgggtctgctgttgggacaggcagcctggaaccacatttccacgcttcagataaaggtggcttccggagcccggcctttcactaccatgccctgggggcaccacaggcaaagacccagacttgaacggctggagccactggtgtccctacgatgtatgtgcagggggaggtggcagtgttgaaaagggacggtcatcactgcaccaccattaccattagcattaatcactgagtgtgtttgcttgcgtcagagcctgtactgttaataaaccctgacctgtgtatccaaccactttacagagaaggaagtgggactgtggatcacagccagcgttgccctagggcttagaggggcccatcccactgtgctttcacgacctggtggcagtggttctcaaccaggggggtggttttgtcccccagggaacatttgacactgtctagagacacgcttatttgtcataacttgaaagggagcgtgtactggcacctagagggtagagacagggatggcgctccatatcctacaatgcacaggtcagctgatcctttatccagccccaaacatctatagtatggggctgagaaaccccaacctaagaggacagaggtaggccaaccacagccagccaagcttgcaggttgtgtccttccagacccttcctcagggtaccagccactcaaactagaagccagtgctcaagaggatgggtgatgtctcttttgctcacagctgcatctgaagggcctaaaacagatttggtgacttgtcttttctgttaaagaacagggacctggctgggcacagtggctcacgcctataatcccaacactttgagaggccaaggcaggaggatcacttgaggtcaggagttcaagaccggcctgaccaagatggtgaaaccccgtctccactaaaaacacaaatattagctgggcatcatggcttgcacctgtaatcccagctacttagaaagctgaggcaggagaatcgcttgaatccgggaggcggaggttgcagtgagccgagattgtgccattgcattccagcctgagcaacaagagcaaaactctgtctcaaaaaaaaaaaaaaaaaaaaaaaaaatagggaccaaatgacgaatgaacaagaaatgcacccaaccaggccaggtgtggtggctcacacctgtaatcccagcactgtgggaggccaaagcaggcagctcactttaggtcagaagttcgagaccagcctggccaatatggtgaaacaccatttcttctaaaaatacaaaaattagccgggcatggtggcacatgcctgtaatctcagctcctcaggaggctgaggcaggagaattgcttgaacccggaaggtggagggtgcagtgagccaagatcgcaccactgcactccagcctaggtgacagagtgagactctgcctcacacacacacacaaaattaggtactattctgggtcttgtttttatagatggaatagtcaaggctcagattaactaataactcacccaagatcccccagccaggaagaaggacctggttctagtgcctatgttgttaacctgcccatcaaacagacctgttgggacctcatgaggccagacactaaccccctgtcctcagctagacatggcgatagagttcccattgtctggatggcagaatcttcccatcactgcagtggttcaagacatccaggctctttgtttggcgggacagccagcctgctctattctcaggggaagggctttgagaatggcttatttagctcactccccaagaagcttatcaccccaaccccacccctgcccaacaaacacattcccatcaggaaagctggacgaccctgccttccatggaatggaagctatgatcccatccattcagttcagcctctcataaacgctctgttccaaacataaccagaatagtcagggagtcctcgaaacccagacatgacttattttctatttctagcttaaccacgtgatgcctgtgagtttcaagcactggagcatccccattcacgctggaaccatctcatctagaaaggggagggtgtacaagcagctctggatcagcccactggggttcagaacaagcaaaagaatttctttacctcccctgagtttcagcctcaaagagcagcaaagaacctggagcccattaaatccagctgtgctcattgtacaaagggaagaactgaggctttggaggacaaagaagatacccagatgatctgcattgctctttttctcccttgcttctttctctcttgttgaattggaataggtcaaacctgtctacagtactcaaatgtcacgggggtttcctccactaggcatggggcagagcttattctcaataaatgttcgagaatgaaacgtcagcaattaactagcaggcaactttggagaggatttcacttcccctataattaaacacaacaaatggcacgaatgttgaagggacaatatgcatgggtgtgtgtgagaaagaggaagagactgcagttcccataccaaataggtatttatttgttccaagacttttttttttcaccaaaaaatgctttaatataatcaccttttaaataatatacactgtcatcttgattatgtctattgggcttactcaaagaggccaggaccttgcagagaaatgagcctgaggtttccttctgccaggtcaccagtcaatggatatttcccaaaaggtggatcttttaatatatgactgcataatttaacctaaaatcctagttagtattctagcaagatgtctccttctaattgaggtaatttctaggaatatgttgctaaaagtttccttttcttcaaataaagcaataactgccatttatgaagcacgtattaggtgccaggtacttcactggccttaactctttgtaactcatgttttcaccgtcacgacaacactgtaaggcaaattacgaccagttcacagccaggaaaactgagactgaggcagaaaagtaactggcccagtgctgcagaaccagtaagaggctgagctggggttagaacctaggaatgactctcaagtccaagctctttatactgtattctcctaagctcagattaaaacccactccatcccctactttcttagtatttcttcatagacagaatatttcaaggaatttaacttttaccacaagggatacaaaacaaggaatgagaggacctgtcttacctccgctttatcacaaccactttgcaaagttactgagattcaacagctttgtctgctaaatgggcacatagcccttcaaccactcctttgctttgctgccagaaacaaaggaaaaggcaggaaaaaagtgcatatttcttccagaattgtcagaggccagcagatcttcctgcaggatgtcagcctaagcaatctttcaaatgctccccgggcaggcagcccaacccaccacactccgctccaaggagacacctcctaaaataaaccctgctaacttcagttagctcaccctaaagactatatatagaagaaaagactcaggagttcccatttggcagcagcttctccaaaactcagcgcaaatggctgatttctaacttaatctccaacatctgacaggcggctttaaatcagggaggccgactaagagatggaaaacctctgtgaggccagcccagcctgcctgggggcagagacaccccagggcttttcagcaaactggaatggcatgaaaatgggaacctggcccccggaggatgcgggagagaaattagacaaggtgtggtgggtgggagcaggatccagcccagccaggccactgggcatgttgtgggggtagctgggggtagaggacagtgatctgtacagaggcactgctgtgaattctgaatcttggtgtcttctgggcctcatgttatcctagagaataacagaaagccagggaaagctttgagtctccacatctatgaaatgaaggatatctctctctctctctctctctctctctctctctctcacacacacacacacacacacacacacacaccccttacctccagagagccagacattcactctcaagacacttttgaaaatactggtctttccaaagaccatcatttgtatttgtatttgaaagattgcttaggctgaattctgtaggaagacctgctggcctctgatagttctggaagaaatatgcacttttgtctccattttcctttgtgtctggcaacaatgctaagaggtggttggagggctgggagcagtgcctcacacctgtaatcccagcattttgggaggccaaggcaggcggatcacttgaggtcgggagttcgagaccagcctggccaacatggtgaaaccccatctctactaaaaacacaaaaattagctaggcatggtggtgcacacctgtaatcccagctattcgggaggctgaggcagaagaatcacctgaacccaggaggcggaggttgcagtgagctgagatcatgccactgaactccagcctgggcgacagacccagaatctgtctctaaataaataaataaacaaataaataaaaataaaaagaggtggttggagcgagatgtgcccatttagcagacgaagcagttgactctcagtaactctgcaaagtggttgtatatcccatggaaggatatacaagaaattgttagcaatgattcctttaaagacagagactggaaaagaaggagaagtctcctattttatatccttttctcatgggggaattttgttatcacatgcttatactccttatatttaaaaagcaagtgtcattcacagatggagggataataaggtggcttctcaaaaaattaaatatagaaaaactagatgtcaaatgctatataatcagcaattcctcctctgggttcacaacctagtgaaaagaaggggcttgaacagctattggcatatctgtgttcaaagcagcattactcacagtagctaaaaggggaaagctagcctagtgtccctcctggaagatctgcgtggataaaccaaatgcaatacacacataccatggactagtcagccttaaaaaggaaggaaattctgacacattccgtgacagggacaaacctcaaagacattatttatgctaagagaaaccagccagttacaaaaggacaaatactgtgtgattccacttataggaggtacttagcgtagtcaaaatcatagacacagaaagaagaatggcagtttccaggggctgggggtgagagtggacaatgaggggctatactttgttgtcgttgtttctttttttgtttgttttggcctgcaaagcgttttagaacttttcaattaatcgctaatgtttgaaactcagaaaatgtaaacaaatctagagtgagagaaagctcatcagttgtttgcctgtggatggggtttggggaagagggaggtagttattgtaaagagaaataagaaaatcctgggggtgatgttcattatatccaataatttggggtgatgatgtcacaggtggatacagatatcaaaactcatcaaattttacactttgaatatgcataatttatcacaagctaattacatttcaataaagctggacaattttatttatttcatgctattcaaacaaaaaagaaaaaaaagaacaaataaaaggcaacacctttttttttttttttttttttgaaatggagtctcactctgtcacccaagctggattggagcgcagtggcatgatctcggctcactgcaacctctgcctcccagtttcaagcaattctcctgcctcagcctcctgagctgggattacaggcatgcaccaccatgcctggctaatttttgtatttttaatagagacggggtttcactatgttggccaggctggtcttgaactcctgacctcaaatgatccacccacctcagcctcccaaagtgctgggaatacaggtgtgagccactgtgcctggtcgcaatatcttaataaaataaatggagattgaattattaatagaaaatgtctaacattttagttctgacagtctatgaaattgattctaaatccaaggaaacattacagaaggagaaattaagatttctaggaatgaatttatttactcaactaacagtggcaatggatgtgggctaacagtgcacttcaactttatctcagttaatcctcactgcaagcccatgaagcatctgttggtattttccccattgaacagatgacaatactgaggcacagagaggccaccttccagaattgggatgagggcagggatgattccagagtccatgctcttacccactgtgccgtgccccctccctcaattgtcattggacacccactatgtgctgggcactctcttggctagattcacagtgagagaagccactttgggccaaaaggctgcaagaaggggcaaatggagatgccggtatttgggcctctccatctttctggggtggaaagtatcactgcacatcatcacaggtacacggagagctccacggtgggcccatttcagcaagaggcattttaaggtcccaggaattgtccaaggcactgctgccccataaaactttctgtgatgatagaaacagtctctgtactgaccccagtggaactcactagccacacgtggctgcccaccacttgaaatgtggctgttacaaatgtggaattgcatttctaattctatttaagattactgaatttcagtgttaatgggaccccacacagagtggattgcacagtgtcactgtgtcagcagagcacagcctggagatcaaagcacagcacaaaggttggcatctcaggactcggggcaggccagccaagagtgcaaccagcacagcacatgggagatgaacttggccctacagaggagccagtgtaactgcctctgaatgcccccttatctacgtttgagtcaaccaggatactgagggccatgtggaccacaacacacatgctccagataacagtccccatactccagataacggtccccatactggcactcactatcccagacgtctcgtgcaagacactttagtgcattacttcctagagaccgcaagaaggagtaactcccatccccattacccaggtgaggaaactgaggtacagagaaatgaagcaacatactcaaggtcacagtcactggcaaagctgggatttgaacccaggaggtttgactgcagaggacaaatttcaaacaactacccagtcccatctcccaagacagagtcacaccatgccgcctgtcctgagacccacgtactcacttccaacaagctgcaggcagaggctttccttttggtgggaggagaaaagccaggcttcccatggagagagtgagaaagacacagtcacaatcccaagcacagggacagaccgttccttctaaaccaccgtcactagccacaaacacaggaaatgcacagcagcttcacatcttcctcctcattttgcacggcccattctctctgccaggaatcccttcttctcttgcccacctggaggattcatatttatccttcccaattcaagacgttttattggaaacctttcctgacctccgaagataagtagaccactccctcctcagctagctggttgcggtcactgccaccacgactctatcctgtaattacttctctctaagcacccatcttcctcactccactgtaacattcaagattccttgtggcaggggctgggtcttatccacttgttttcccagagccaaacagggtgtctgacatacggtcctggctcggcaactgttgacttgcaatggcaatgataagatgaatgatttcaacaaaaggaacatttacattttaagagctgaatcaagaactcgcttatgtcaaagaaagagactagtgagtatccctcaatgtcttgggcactggaaacaggccagggtgtgttttccaactcagctactttctataatagctgtgtgacccaaagtggaattttcttttttttttttgagacggagtttcactcttgttgcccaggccagagtgcaatggcaagatctcgactcactgtaacctctgcctcccaagttcaagtgattctcctgtctcagcctctcgagtagctgggattataggtgcccgccaccacgcctggctaatttttgtatttttagtagagacagggtttcgccatgtgggccaggctggtctcgccctcctgacctcaggtgatctgcctgcctccacctcccaaagtgctgggattataggcatgagccaccgcgccggcccctaagtgaagttttaacctcttaaagctttccggtttccctccataagatgaggataacattaggatcggcctctgggggttgctgggaggatcacctgggctaataatgtatgtaaaacacttggcatagaacctgggcttctataaagcagttccagccctgggcccaaaggatcagaatgaaagcaaatgagcaggtaggagttgatgctgtacaaccaatcccaggtaagtaggtggttttgccaatttcttctcctttagtcccaccaagttctgagagaccctgggcccattctgtctctcggctggccagacccggttttcaggggccctcagaaaagaggtcacccactgatcacctccctagctgaatctgactcttatatattttgttttgaactgcaaagtgtttttaaatttttcaattagccgccaatgttcaaagctcaggaagactgtgcattcaaattctggatgtctaaccttctttgaaaaattagatttggcctcactgggttcatactttgaattgactgaatctgagaggcactgtctacttcagatgtggtgtgggagtgcccagtccccatgtggccaggacacttgttctcactaccaaccctgcccagaaaacatctaactttgcaactcctgccctagggaaggaagttggccagaaataggctgttttatttagcaaagctattagctaaaagcagggagcagctccgagggtgagtaaaaatccgcattccaaactcatctgacttctctttgacagcaccggtatgtaaagatacagatgaattaatcattccgtttagtaataaactaaccctgttgttgctgcctctgtcatggagaaagcaaaaaatcaatcgctggtggaagcacttctcaatctacacctgacagaggggcgacagttagtgctgtcctattcccagcatcgggcctggaggaattcctgattttaggtgactgcagagtccttgaaggaggtaaaagctgctcacagcctgacagttctctgcatttactcccaaagaggagatgacggagcagagagacatgatccgatgaagagacaaacctgtccatgtcactcacctttatgtcttattggaagtgtcacctcttcgtagatgtgacaactgaacctagtaaatagaggcccccgctgcctgccccatccccataacacacataaacacacatacacacacacacacacacacacacacacacacacacacacacctatgtactccactgttggcctccctggaacatctgccagaggctgtaatatcttatttgttctcttgtgtgctcttttcagctatattatatgctgtacgaagaaagtagccttgtctgatttgatctgtttccagctacttgtctgtttctggcacctcacatagcccttggcacccaacgagcccttcctgaaaatttgcaaatgcatttttgacacaatacacggtattctgtaacgtttccaaacttccaatgcccatgcactagtttcacggtttttgccatatttctgtaccacccagtccagtaactcagtattttcttcaaccaactctcatcttgtagtgaaatagatctctttttaaaataaagctttacggccatgcatttggtcaatagagagacacctgtaattgatgagctctggagttgacagtcacctatgagcagtgtgaccctggacaagtgagttaacaacagtctatgaaattgattctaaatccaaggaaacactacagaaggagaaattaagatttctaggaatgaatttatttactcaactaacagtggcaatagatgtgggctaactgcacttcatctgcaaaacagcactaacaatagcacctactgaatacagaggtggttcaagggtaaatgacttaaaacatgtaaagttaatttacggcaagtgcttccaatagtgcctgccacagagccaacacgatatgaatactgcttgtattggtattatttaggggggaaaaccggtatcgctttaaataaatacatgacaattaaaaaaatcacttatgtaacagctgagaaacacttttggagacatgggctaagcctgagttttactgctacccaaatgtgaaaagcacccccttcgccaggtcctcatctcccatcttttaaatgaagatgttgggccgggcactctaagattccatccatcttccagttctgaatctctgactctcagtcatggataacactaccttaaaagaaataaaataggaaaaacctgaatttacacaataagctcaaaaggaaagagctggaggcggggaggttattcacattcccaaaggatttgcttttacaaagggattaacagcagagttgctttaaatagcagcttaagccttgtttatggattactagatacttgatggagaggtggaggggctcaggaacttggaacaaaagctttactacacccaggcagaaatgaaaaagcgcatatgttttctttaaaattacaatacacatcaacaggagaaatgattccatttcaaggaagctgattcctactcagtatttccgttgcatgtcaattgcatccaagaagatatgcctgtatccacgagccagtttagagcagtaatccagtgttcatatttttaagcccctattataagagcactgataatttattaaatgtcccaggcactgttgagcatatgacatgcattacctcatctaatcttcacagtaacccaataaggcaggtgtagttgtcatcatccttttacagatgaagaaactgaggctaagagaggggaagtgactcacccatgtcaaaagatggcaaatttaatagtcaagccaaagcgcatgaacctggctctgaggttagattataaaaggtaagatccttgtctcaaagagggcacagaacagccacggaggtcaacagactcagaggaggatgataaatgccccaagagacacctttgagggagcagaagaagaggatatcaaggtctagggtgtgcccaaagccaggagtgacctcatctgacccccaggtgtccatattcgagcatctctaaacactcagtgtatggattcctctcctccatccttcatgcatagaccctcttatctgtacctccctatgcacaaaccaatgtgtcctaggccactctattcccgaaaggtgggctgtgggactggaggcaaagagagaaagaacaactgttgcagggtctctgccagcacccacactgcttcactagactacctgagagcttcccattgcctggttttcctcctttgaaaaatggggatattcgccaccccccacctccctcagcagggaagcactagtgattaattaggtaacatctgtgaagcactcccagctttccggagaagggcaccttgggagaggagctataaaaacctgaggcacaggctattatcagcgtgatcattattatcatcattgtcattatgacattctcctgcccaaagacctgcagtggctcaccactgcccagagaagaaggtgccattggctgcctggcaggcaagggaaccgctgctaccccctccctggactctcccacccccatgcatctctaaccaataataccctatatgtgagtcctgcaacttccacatggaaccccttctcctcagagcagctccagtcttgcccggtccaagaacctttcctaaccacgtaggctggaagctcaacattggcatgcctatttctgctgtagacaccaagatttttctcctcgtgaagattctattcagaggaatacacaagtgcataaaaaacagtgatattgcatgagtttctcttttcccagagctataaaacaaagatgctacacaaaccatgactcagtatcttagactgatgctcgtgacttataatgggttagatccaataaacccaccgtaagctgaaaatagcctaagttgaaaatgcatttaacgcacctaacctaccgaatatcacagcttagccaaccctgccttaaacatgctcagaacactgacattagcctacaattaggcaaaatcatctaatacgaagcctagtttataatgaagtgttgaatactgtacatggacattttgcagacatgacaggatgctaaaacacaaaacacactatccaaatacatcgctagcctgagaaaagatcaaaactcaaaattcgaagtaaggcttctgctgaagatacatcgctttgcaccaacgtaaagttgtaagtcaaacccactgtgagtgactgtctgtgtctctgattagatgataagcatgtagaggaccagagagagttcagataaagtctacaattcatgaacagggcctcaggaactagttaagggaacaagcacggtctctgggttcagacagaccagagctccccattctgcctgtcaccacctccctgagccccaacttcttcctctgcaaaatggagaccagcatacttaatatgaacagttaaagaaaaaactaatccggattaagtaaggagaaacatcattggaaaggattattgcgaagggcagaaaggaaaaatcacactacggagggtgctttaccataagatcttaaggatcctgaagcatctcaaaggctaggcaaaaaggagttttcttttaacaaaaaggagaaacaaaagcaggtttggggaagaaaggatggtatgatcagagagtagatcagagaatgttttaccctgatgccagccttttctcaggaggggctgtgtgctggctcacgctcagtgtgggtcaaggcaaaagcacctggaggaagaagagagtctgatccaaagtctggtgatcaagcatgttgttctgattgatcagtgggaatgagcagccagctcatcctttataaggtaacaaatgggaatatgcagggtctgggtctagccctgtcctggggaaacaaaagggtatccacgagttgtagctaagtcacgtgggcaacactggttctttgcagcgaggcattttctgcaacacaaacaggtgagtggattcctttaacctttgttcttttgcaggagcacagggctcaagtaaaattcagcattgttgatccccaagaaagtggctgtgtagattcaatgtgccaatgcatagaaagcctttaacaaattgagtttttatcatttttatttttcttagagatagggtttcaccctgccactcaggctggagtgcagcggcacgatcctggctcacttcagcctcaacctcccgggctcaagtgatcctcccacctcagcctcctgagtagcgaggactacaggtacacgccaccacacctcgctactatttttgtttaattatggtttatctgcaggatagtatagaacaatcattgtaagaggcagaaggttgagaaaggagtacagacattctggaggtgtcttgcaaataaatatgcagccccggagtggatctgtttagccagccaggcatagaacacttctgactcacactggactttctgtctgatcagccccaggccatttttacatcatcttctcttaagcaagacaggtcttcagcctaaaacacatccaacatagtccctggcgattgagaagttcaaagaaaaataaagtgaaatatacagcccaccactgcaatccatccaagaatcaaagggtgtaggcttcaagacaggatggagaaccaggagttaaacaaaattctccactaactttttatcctctgctataatcagtggcatgcaaacctgttttaaatttaccgacagcttaagctgccacccaggtcttgaggtatttttagtcaactagaaattcatttagagcctgaagtcagggaagggaatcgtgtcaggtgtggctcctgcaggattcaggtcgtgccctgtacctgctttagttaccactcctcatttgcacacaattaaataatcacttcaccccctgcccatctcttcagcatcttcagcatctcctcacaaagcagcaggagaggggaataaaacgtcagggaagtcaactctaggtttaagagatctgttcttaatccgaacatcatttccattagcagaaacaaactcaacagggggaggcgagtacaaggaatatagggccctgagccgaaccaaaagagaacaaattcctctttccccactcaaaacaggcctatccaataaagttgcggctgtatgtacgtgaataagctgccagcaagaacgaggcagacacaggaggaatgaaattaatacttcggggtggggagtggtaagaaggtgcctaagtcgaaagcaaaaccacccaccctagtgtacaagccaagcatggaggaggcaccttcaatgcctctttatccttcaggcccctgtggccaacacatctccaattcactggtaagtcaacagagtctgtccagaacttgaaactgcctttgcaaaaacggtaacagtgagaaaattatgacagtgaaagaggtctgatctaaccaacccccatcttgcctttacctccaaaccgctcatgatcattcctgggcttgggtcaagctaactttcagagacatttagtttatactttaaaagataacagtccttccccaaaactaaaccacctttgtaaagctaatgtaggtccattaggttacaaggattaaaaggagccttggccaggggcagtggctcacgcctgtaatcccaacactttgggagcctgagattggtggattgcctgagctcaagagttcaaaaccagcctgggcaacatgacgaaactcccgtctctactaaaaatacaaaaaattagctaggcatggtggtgcgtgactgtaatcccagctactccagaggctgaggcaggagaatcgcttgaacctgggagatagaggttgcagtgagacaagatcaccccattgcactccagcatgggcgacagagcgagactccttctcaaaagaaaaaaaacaaaaacaaacaaacaaaaaacctgaattctgctagtgtaaaggattcccagccattattcctgaggtcacaagatttgcaacttccctgattcctcctgcagataacatcactcctgtagaacctaagattggccttttgagatgtcttttcaggtttttgcatttcttttatttaacacttgatatgaactaggggaagatttttacatttctgactatgatggcttgacccagacccaccaaccagtactgtgtcctcaccagaagaggaccattttccacccacccctgtgattgcatccccaaccaaccagcagcacccataactttgtccgccaaactatccttgaaaaacactagcctcaaaatttccagagagactgatttgaatcataaaactccagtctcccattcagccagttctgcatgaattaaactctctctattgcaattcccctgttttgataaaatcagccctatctggacagtgagcaaaataaacccactgggcaattacaaactgtccacttctgaccttgaccaccactatgctaacccaagtcccagtcatcttggatcccaacatccctttactcccagggtcctttcttcttccagcagccatcagaggcattgatagggcttggctgtgtccccacccaaaactcatcttgaattgtagctcccataattcccacatgtggtgggagggacccagtgagaaataactgagtcatgggggtagtttccccccatactgttctcatggtagtaagtctcacgagatctgatggttttataaggggtggttccccctttcacttggctcttattctctgttgcctgcctctacgtaagatgggcctttgctcctcatttgccttccgtcatgactgcaaggcctccacagccatgtggaacgttgagtcagttaaacctctttcatttataaattacccagtctcaatgtctttatttcgcagcatgagaaatgactaatacaggcacccttataaaatcataaaccaaagaacatacaacatagcaatttgtaaatcctacatgacttccccatctccctggaaataaaatctaaacttctctccttgatcataaagccctataggatcttacccctgcctgttcctcaagctcatctgacaccatgcttccttcttcctctgtgctccagcaccgatggccaaaggtttctagaacattccattctctctgccgcctcaaggccatttccctctgcctgggaggtttttcatccaagttttcacatggcttcctggtcgttgaggtctagggccaaatgtcacctccctcagggctctcttgggaccaccctcttcaacacatcctcctattttaatcccatgtataatatttgccatgttaacaggttctactttttttggtctgtttgatctctgtgtgttattcactgctgcatcctcatcgtgcacactagctgatactcctaaaaaatatttattgaatgaataaacgaccatcggaaggagaaaggaaaccccttctctctcaggaccccaaattcactatgccaaatgggagagttatgcttggaaactgagtcatgcaaaacactgcctttccctttgttcctaaacagacagctgcaagacagaaggccacatatctctccaggtggcctccctcgccttgacaatgtaaattaacagcttatcttcagaggtatgggacaaagacaagactagaaatcatcccccactgcccaccctaagacaaatgtatatttgacgtttccctccactttatgtttactttatcccatgtaaaatacagatttactgagcttgagacaaatatataagtgactgttcccctaccccctcctttcaaatgcaagatgtgggttcggtaagagttaattaaagcctcataagaatgtgacctctcacctcactccctaccttccctcttttctttccttcctccttcccctcctgcccactttttcccctttaaatacagagtcctcaaagccctctttggaaaaagcacaggccagatcctccagcgactttcatccctttttcctggggatgtcctcaaccttggcaaaagaaacctctaaactgattgaggcctgtggcagacactttggtttgcagaagaaaccacaactgtagcacatgatgtgagcaggtggatctgaaggtgatggtgtgtattttacatgacggcatacctcaatgtgtttattttttatttctataaatgtaaggggtgcaggagcaattctgttacatggataaactgtggagtggtgaagtgtgggcttttagtgtataccatcatccaaacggtgtacattatacccatgaagtaattctcatcatcccccccaaccaccctcccactcttcacagtctctagtatctatctcattccacactcaatgcctgtgtgtacacatatttagctcccactcccactgatgagatcatgctgtcatatctcaatgtagatgctaaatgttcaccagcaatacatgctacatctttagagttcggaaaaatgtcatatgagtctgggtgtggtggctcacatctgtaaccctagtgcttttggaggctaaggtgggaggactgtttaagcccaggagttcaagaccagcctgggaaacatagggagaccccatctcaaaagaattaattaattaattattattattattattattattttttgagatggagccttgctctgtcgcccaggctagagtgcagtggcgccatcttggctcactgcaagctccgcctcctgggttcacaccattctcctgcctcagcctcccgagtagctcggactacaggcgcccgccaccgcacctggctaattttttctatttttagtagagacggagtttcaccgtgttagccaggatggtctcgatctcctgacctcatgatccacccacctcggcctcccaaagtgctggcattacaggcatgagccaccacgcccggccaattgatttttttttaaatgtcaaatgaagtaaattctcagacccaagtagttccaaatatatttaataactgaatcaggtatcaggttttaaattaatgaaaatgaaataaaagtaaaacttcaatttctcactgctctagccacatttccagggctcctgatatagccccatgtggctgctggccacctcactggacggtacaggggtggctcatgtcacccaccacagcagcgatcaccgttgcagttcacggagaacagatttctactctgccttcatggaggtatcttctccatgggaggcagcggtggtctccacacgatccaccaagtccaaccctgccagctttttcattctgctctctcagagaagctgatatggcccagtgattccaatagggagcatctgggcagagtgccctggaggcagcagtccatcctcactgacatacagcacaactttacccactgtgcaagaagcacctgagcttccatgtcagaccatggaggaggacagcatttctggagataaataaagccaccacgcttagagaaaacaacagaggagggtgggaagagctctggccctggagctagaccgcctgggtttgaatcccagcagtgctactgaccagctatgtgaccttgggcacacaatttaacttctctatgactcagtttacctataggcaaaaggtcagcacctaccccttagaggagttgaaaaggacaaatgaaacagagtatataaagcatttgttgggctgggcatggtagctcatgcctgtaatctcaacactttgggaggccaaggcaggaagatcgcttgaggacaggagttcaacaccagcctgagcaagagagtgagatccctgcccatcccccctgtattagtccattttcacactgctatcaagaactacctgaggctgggtaatttataaagaaaagaggtttaactcactcacagttccacatgggctggggaggcctcaggaaacttacaatcgtggcagaagaggaagaggggcaaggcacatcttatacggcagcaggagagaatgagagtgaagggggaactgccaaacacttttaaagcatcagatctcatgagaactcactcactatcatgagaacagcatggggaaaacctcccccctcatccaatcacctcccaccaagtccctcctttggcacatggagattacaattcgagatgagagctggatggggacacagagccaaatcatatcaacccccacccacaccaatctcttaaatattaaaaaatggaagggtggtgcattcctgtagtcccagctacttgggaggctgaggcagaaagattacttgagcctaagaattcaaggctgcagtgagccatgatcgcaccactgcactccagcctgggcagcacagcgaaaccttatctctaaaaaaataaaaataatcacataaaacaaagcatatgtcacaagtgcctggcacatcacaatgactccctataaataatcataataattattcttgctcattataatactttgagctctgctcacagaagtacagaacaacacaggtgcccctgttaaactgaagccaaacttctaaagcagatcaattaccaggagatcattcacaatataaaggattctcatcggggactcctttaaatacagtgaaatctgtgaagggcttttcaaatcggaatcaatttaccatattgacatggaattcttcagggacccttcggggaaggactcagatgtagtgtcctctctgtcactctcatctgttggttggtgaacagcagactctgttcaccattcctacaatcagccaaggggggctgtgatgtttcacaaggcgccacggcagagagatgaaagttgttatgggtgctgttggattttagggctgctaagagaaccagatgtttaaaagtagccctgtgcaagtccaagccagagctgccaaattctcgacgcatgaaaaacaaaggcgtctggcttgggaaagtttgtcccaggcagactctctgagtctatttagaaagggttacaatgcaacgtttgtatctacacccctcctgtacaggtttgcaaaaccggaaataatgcctgtcactcatgcagtgactcctgggcacaaccttacagccagtccctgtgctgggcatcaaggaaatacagagatgacgtgaaatacctgctgggtgagccatagaagcaaagcgttatttgcttctgagtctgaaagctcagctgggtgaccttgggcatgttgcttaacctttctgtgattcagtcttctcatctgtgaaatggggatagcagcaggaccttccacacaaactcactgtgagaaatgagtaaagataaatgaaggggttggaacagctcctggcacacagtaagtgctcaataaatgtgtttattcttagttgtggtagtagactgctgataaggggctaaattcagggtgttagggtagtacataaaaaagctatctaggctgggcgcggtggctcacgcctataatcccaacactttgggaggccgaggcaggcagatcacttgaggtcaggagtttgagaccagcctggccaaacagtgaaaccctatctctactacaaatacaaaaaattagccgggcgtggtggcaggtacctgtaatcccagctactcgggaatctgaggcaggagaatggcttgaacccaggaggtgcaggttgcagtgagccaagatcaggccactgtactctggcctgggcagagtgggactccacctcagaaaaaaaagtatctaactagagtatcaggaaatgattaccatcccataccatagccagattcagctcgtggcctattttcgcaaataaaattttattggcacacagccacgttcatttgtttacatgttatctctggctgctttccggctgcagaggcacagttcagtagttgccaaggagactgaagggccctcaacatctaaaatacctcttatctgctcctttaagaaaaggctggccaacctctgatccaattcaattcaggagggatgtgatcagggaaggcttcctggagggtgacaacgtaaattttccttggttaatattgactcttgcatttcagagttattgaggaggatgcttggatcggcaggttcgggtaacagaaaggaaataagcattgccatcgacctctatctgaatcaaatcctacagcaggcatcacagaacggtggctcatgggcccagaaacagtctgcaatctaatttgatatgaacctgtggtgcttaaaaaacacccgagacaacattggatggctgggatacatcataataaaccgcctttccggcttctattaaaaactctgacgatctggcaaccctgggcccacccttcccatggagaccccttttgctggggtacctgttctccagatcaccatgagaaccttttcattcccccctttactctatgtctacagcctctgctctgatgctatcaaaggcctctcacacatattcttggttccctgccaacccaggcagacaaggcaagctgagaaaactaaagttcagagaggtcaagtgactttcctagggatagccatctggtgaatgataaagctggaccggaacctgagcctttgagtctagctcactgtccctcttcagacatacaaacagcggaatgagtcattgctacgattttactagggcactccatagtttgaatagctctttttttttttttttttttttgagacagtgtattgcccaggctggagtgcagtggtgcgatctcggctcactgcaacctctgcctcccgggttcaagcgattctcctgcctcagcctcctgagtagctgggattacaggcatgcaccaccattcccggctaatttttgtattattagtagagacggggtttcaccgtgttggtcaggctggctcaaactgctgatctcgtgaacagctctttcacatatacgagtccagattggaaaatgcagaccttggatccacggaggccacgtaaatattgagtggcatatggtcaccaaaggactgacaaggcaagaggctaaaactccagaaagataaggactagaagtgcatctagtctatctcaggagtcagagtgggcaaatctactgaatccaacaagcactgcttaagtgcctgctggaatcaagacaaagaaagaggcccagctccccatctggggcttagaatgtcacagggagggtgttacctgtaaagtaacaacgtaagaccgactgtgtttctgcaagactaaagggcagagacagctgaaacttcggtggcctacatggcagatttaaggacttactcagggcacaggtggagacgtggatttaagtgagtatgagtgatttttttcggggagtagatgatgggtgaaccatggcccttggatgatgtattcgtttcttgccagctgccataacaaagcaccactaaatggcttaaacaatcaaaatgtattgcctcccatttctggagcctagaaatctaagatcaaggtgttggtagggttggttccttttgaagcctgtgagaaagaatgttccatgcccctctcctggcttctggtggtctgctgggaatcttgaatgttccttcgcttgtagatacatcatgcccctctctgccttcgccttcacaaagtgtcctccctgtgtgcatggctatgtccaaatgtccccgcccccccccactgtttttttgttttgttttgttttgttttgtttttggcagagtcttgctctgtcacccaggctggagtgcagtggctcgatctcggctcattgcaacctctacctcccaggttcaggtgattctcctgcctcagcctcctgagtagctgggattacaggtgcatgccgccacacctggctaattaaaatgccccctttttataaggacaccagtcatattagcttagggacccccccgcttctagtatgactgcatctttgcaaattacatctgcaatgaccgtctttccaaacaaggtcaacttccaatgtactggaaatcgggacttcaacatatgaatctgggggcaggagaggggacataattcaacccataacagatgacatcctcaaagtcactgggaagcatggcaacggaggctgagatgctcaaggccatcctcgaggctcctccccacaaagggtaaagacctgggttctccctggcctttctgggcagaatgagagtccccagaggttctggtgctgttggaaggatcctaagcatcaagggaaggggtgtggacaactccaggcctccagcactgagagcaggagggaagccctgctccctcctcattacactgtggaaaacagaaaactcaatttatttaagaataaacaggctttaacctgaagttcattctcccgctccatgatgctttagcatctacatgcaaccgcagctgccagcatcatgccccggttgcacagtccgaaggacctatattggaaaaataatggcattttctcaacaaattatctcacagctgaagtaataacttgtttaaagatacgccaattcagattttcatccccttaacctgccactaaaagaaaagcggtgtcatccccatggcaaaacaggagcagtttaatcacttctgcacccctgtcctccggccctcgcccccaactccagcccccaccaccacccacagctgcacgtttattaattttaagccattgacagagtctctttggaaaccatgtttttttacttctcaggtcaacatcctccagctctgttataataaagtacacactgccagagataaagcaaatatttctttgggaaaggaaaacaaaatagagtggctgtgttttcaacacaatcgctaaggatccagccagcggacttcttctccaacagcagccatcaggctaactggccctcaccaggcttctcatttatttggcaacaaggaaatcacagcttcaaactctctcctggcaacagcagctttctcagtcttcggccaggtagacaggaaggacaggggctgacagtgaaaggaatgctgggagacacatcaagcattcaatcaacaaacagtgggtgcagctgaccctgtgcctggcactatgctagattctaggtacctcagtgactaacacaaattatagtacctactgtccccaaagaacttgcagtttaggggctgggcgccatggctcacacctgtaatcccagcactttgggaggccaaggtgggcagattatttgaggtcaggagtttgagaccagctagccaacatggtaaaaccctgtctctactaaaaatacaaaaattagctgggagtggtggcacgcgcctgtaatcccagctacttaggaggctgaggcatgagaatcacttgaacctgggaggcggaggttacagtgagctgagatcatgccatcacactccagcctgggtgacagaaagagactccatctcaaaaaaaaagaaagagagggagggagggagggaggaagggaggaaggaaggaaggaaggaaggaaggaaggaaggaaggaaggaaggaactaactaacttgcagtttaggaggagacacaggcaatgaatcaacccatcaaccttcaaagtcagcttgtaatgaaagccacgagtgaaagaaacaaggtgtggagttagagcgaggaaggccagccggaggaggggacacctgatctgaagtttgaaggacaaacgggaatcaaccctatattgggaaagtagtaaccctatactgggaagaggaaaaaaggggaagaaaaacagaagtaacagccagggggatgacataatccagctctctctcctctgtctctctgtctcactctctctttcatacacacacacacacacacacacacacacacctgtctacaatctattcttcagagtcaattctttaacattagtgtttgacaaaatgcaactctccctggaatgaattccaatcagccccagctcagtgtggatgagttttttcagagatcatggctggaaagcttgcaagggagatgatagcacatagggacactgggcccttgggctggaggatgttacaaaggaaaagggacgaggaagcaagggaaacggacttcagatcaatttccaaaacttccaccattctgccttgaggttgctgggaatggagccacccggggtgggagagtcttccagaaaagccagacggacttcctgcaagttcaatctctgcctaaatttatacagagagatatacttatgggcacatatttagcatttgcaagctgaagttgtggaaatggcacaagaactggccagggcaactttgagcttaccgatgtaactatgtgtagtgttctgcaactgagttttttgaggaaagggatggcttcttcaacatccttttctatgttcccgggcaggtaatttaacctctctttgtctctgttcctatatctgtaaaatgggaataacatcatccccacctcaaggagctgggaggggtaaattttaaaatgtatgctaagcactcagataatgcctggcctagttgttcaatgaagggttagtggctatggttattattattattattattattattatatcaacttccacaacatttaggagcactaaacatttatggaatgtttcttggccagtcagctcctgcttaaaaaattattacagaaataattagaaaataaaataaaagccataggcccaaagatatttacaacattatttatttagaatatcaacaaaaatctaaatgttcaacaattgagcaatggtgacattaaataaggtgcatcaacgcagtggtgaattatgcgctaattagcaggatcagcagagagatgacagaaaagctttaaaagtgtttctaggctgagcgtggtggctcacgcctgtaatcccaacacttcgggaggctgaggcaggtgaatagcttgagcccaggagttggagaccagcctggacaacatagcaaagccctgtttctacaaaaaaaaaaaacacacacacacacacacaaaaagttagccaggcatggtggtgcacacctgtagtcccagccaaccaggagactgaggcacaagggtcccttgagccggtgaggtcaaggctgcagtgagccgtcattgccccactgtactccagcctgggcaacggagaccttgtctcaaaaacaaaaacaaaaaaaaaagggtttacaaagcactattaagtgaatatgaaaaagacgaagtgtacacagtttaaaacaatgggtataaatacagaaagaaactgaagatgtgaaaattgcagttgggttggaatggtgggttatggataatgttttttaaaagatagtttacaacatgagaaaatacaaaataaactgcttgtggaaaaaataggattcaaacctatgaggggtttatttgggggctgttggagcatacagttcctcctttaagacatggacaaaaagaagctctctctcttgtctccatggcaaacacctaaatggaaggtgaaaatgcccatcattaagctctcttgatattgagcttgtcttattctacatacatgggtgtttgttttactatatccttttttttcttttctttttttttttttttaagagatagggtcttactctatcacccaggctggagtgcagtggcatgatcacagctcactgaaacctcaacctcctgggctcaagcaatcctgcttcagcttcctggaaagctggaactacaggcaacttccaccacacttggctattttaaaaattttttgtagagacagggtctcactctgttgcccaggatggatataccctattttctgatgaattaatagataaatgaatcacaaaatattcaccaggtgcttatgacatcaaaggcctgtgcggaatgaccatcatcccagcttccagagtgaggacctcaaatatgaagacgatacacagagacaaacaagtaactgatggtaataagccagccacagctaacacttaccaatgcttcctgcaggccagggatcactctatggattttatgggaatacctccctttaatcctcatatccagccttggatgcagctatagccatttgacagatgaggagacacactcacaaagggcaggcgtcttgcccaagtcatacaaccagtaagcggcaaaacctggctttgaacctacaaatcttctgccagggccggcgattttaacacctggattagtctgttttcacgctgctgataaagacataccagagactgggtaatttatcaagaaaaaaaggtttaatggactcacagttccaggtggctggcgaggcctcacaatcacggcagaaggtgaaagtcacgtcttacatggcaacaaacaagagagaatgagagagcttgtgtagggaaactcccctttataaaactatcagatctcatgagagtcactcactatcacaaaaacagcaccagaaagacctgcccccatgattcaataacctcccaccgggtccctcccacaacacgtgggggaatcatggcagctacaattcaagaagagacttgggtgtgaacatagccaaactgtatcactactctactgcagaagaagagccatgaaagctgttcacagcaggagaggcaaaaggccctttcctcaaagcccatctgggaatacctcacccttgtctcttctccagacacaattctccattgagagccgtcctccaagacctcaggttcataagggctagaagagcagcttgaaacgctggacttgccctttggagccagaggtcaggccaggtgggagccatccactagcaggttagagacaacgagattctctctgtgcagttcagaccacagccacagagaattatttaaacccctcctgggaaaccgcagcaacgtcagacagattcaatgtgcataactgtatgtgtgtgtgtctatgtgtggttggggggggggctcagggaggaggtgtgacaagcctgagtgacccaggagggactcagggcccaggaagggtcggatactcctcccccatccaggtgggacacagcgagctgagcagcccctgatgaaaccaaaagagtctcagatcctgtcccttttcctcctcagaactcagagcactggatcctttgttcagaaagcaagagaaaacaccaacacaattcctgctacagctgaggatgagggcgtggagcaggtcacacagacatactagcaagcctgcaaagtcaaaaccgtaacagccacagtaactgacacacgtcaacaactgacctggagccagatgttgccccatttaacctccaagactctcctgtgaggtgagaaccatgatcatccccattatacaggtgagaaaaccaaggctgatgggaattcatcacatggtgcataggaagcaaagccatgtttcgaatccaggaagcctctctgtcttaggaagacacgcacccactcatgcatgcaacaacagatgcacaagtaacagtcagagttggccaggcacaggggcagttgcctgtaattccaacaactcgggaggctgaggcgggaggacgacttgaggtcagcagttcaagaccagtttgggcatatattgagaccctgtctctaaaaaataaaaatttaaaaagaaaaacattcagagttgtgtacattcacaaaaggcatgcaaacatagcatagggatagaaatacaggcataaacgtgtgcagagagctgcaaccacgcgcatctgcccctcttctccaaataagggctgcctctttgcacacctctgagaggtgccctccacacagaatacaacatacacttgtaatattgccacacacaagcacataactttctggagggatgactcagattagaaaaacagcatttagagggcccctggttaatcaaacggcctcgccaccccgcgccacctctctacacagctgatgttgctgatcaatgtcgcggctgtgcagagggggcatttgataccacaaagggagccaactcctgctgaggaatgaatgtggcgcttgtcagctctgccccaggcagcagcacaacatgatgccctgtttctcctggaatcggggccctgcgtccgctccagccctcattttcatgtctttcttcccaacagacacaaggccggctcagttctggagaaacagcgtggctgccaaggcccagtggagggagaaggccttgaaaagtcactttataaagcatccgtgctcgcagcagccaagccacgaggccggagcggctgactttccattcgccacacaccccacccaaagacgagaactctgccacagccagcccttgttctcacccactgggagccctggggagttgaaatcacagggacagcagcagggagcccttggcagcaaacccagctcctggcatcttcctcgggggccgtagcttgctgtggtcagccgagccagtctgatgcaagaactgaatgacgcccattcactgtggtgccctcgtgagctgggagatgtccaggctgaggctggggcaggcaggctctctgtcacctgcagaggctgagacaacctcaaggtaggacgagaacccagggttgaagctagcagaagccaggccctggggcccctgatgcatgatgagagtgaaaagaagggcacagtgatgtaaagaattcctccatttcccctccctgccctcagttacttcctatccatacagaggggggatgaaaactttaagatttcactattcagctgagactggtgactcacgcctgaaatcccagcactttgggaggctgaggtgggtggatcacttgaggtcgggagtttgagaccagcctggccaacatggagaaaccccacttctactaaaaatacaaaaattagccaggcgtggtggtgcatgcctgtaatcccagctatttggaaggctgaggcaggagaatcgcttgaacctgggaggtggaggctgcaatgggctgagattgcaccactgcagcctagcctgggcaacagagtgagactctattttataaaaataagagactccactattcatgcattcacatgctcattcaacaaatattactgagcacctactatatgatgagtgttattgttttaggcactgggagtacattagtcaaataaatagtcaccacctgcatgtagcttgttctcaaaattctcaagctctcccaaccctccccataatgaacagctgtgtgacttagagcacactgcttcccctctctgtgctccagtgaggtctctcccagggttcctgtgaatcaccatctgggatccagtaagctcccccatggggcctaaactagactaagttggtttccgtcactcacagccagaggagtcctgcctaagaaattgggaaagagagcggagaagacaaaaagcaggtttgggaaggctgcagggagctgatgagtcatttgatcatctggaaagcagatgggaagacaagtggagaccaggaggccctggggaagagaagctgtgttcacgccaaccttccccagcaggcctcagaagctgggggtcaaaagggaccacaacgcccatttaaacaaggaggaagatgctgaacagctaaagggttaattcaaaagaaaaaacaaaagaagaaatggccatttcttttccttgttcactcaatgttccttcaacaaattattctatgtgcttggaatatatgaggccctgggttgggtgtggtatgcaacagaaaaataaaacataagaacatagtatgtctcttcccacagggtcatatggtctttcgaaagtcacccttttaatttgaaaccttttgctgcttctttatttttattttttaatttaatttttttgagacagagtcttgctctgtcacccaggctggaatgcagtgacgcaatctcggctcactgcaacctctgcctccggagttcaagcgattctcctgcctcagcctcccaagtagctgggattatagacccctgccaccaccccagctagtttttatatttttaggagagatggggtttcgccatgttggccagcagtcttgaactcctggcctcaggtgatctgcctgcctcggcctcccaaagtgctaggattacaggcaggagccactgcgtccagcctatttattcttattttaaaaatttatatatatgtgtatatatataaggggtataacacagcgttatttttaaggaataagagatattttgcttttcaaagtgcctgctaagcccagtgacatacgcttggttagcaatcactaaatgtggacacattataaatcctctatatattttatagagatggggtcttgctatgttgcccagtatggacatgcgttcctgggctcaactgatcctcctgctcagcctcccatgtgctgggattataggcatgagacagcagcactcagtctctttgtttatttctctgcctgctccccacccatctgtgtgacccctactaaaataaccactgcatggtgttcaaggaagagtatggccttgggattcaggcaggtctgcattctaacccagggccttctaccttctggctatgtgcccctgagcaagtaacttggcctctgctatggcttagatgtgtgtcccctccaaaccgcatgttgaaatttgatccccagtgttggaggtggggtctaatgggaggtgtttgggttttgagggtggatccctcatgaatagatcaataccctccttctattagttctgcaagagctggatgtttacaaacagtctggccttcccctccctctctcttgctttcttgcttacctgtaatatctgcacatgccaactccccttcaccttccactgtgagtgaagctgtcggaggccctcgccagatgcagatgcctaatcttgaacttaccagccatcagaatcacaaaccaaataaactttctttctttataaactacccagcatcagatattcctttatagtaatacaaaatatacgatgatagcctctcagagcctcaatcacctgccctggaaaatgggtacaacaccgagttctttttaaggaataaatgatgttttgcttttcaaagtgcatgctaagtaagtgcagtgacatacgcttggtaagcaatcattgagtgtgaacatattataaattctcatgaaatctaagaggcaaagccctgggaatatcacaatattgatcttctaaagtcagtatcagctttctcatggctcagactcactcctgagttttgtgcttggatacttaacaattgctcactcctaaatttcctaactagttccagcttcaaactggaaaaattcctccagtgtattcaagcctcgttgcctagcaccacaatatccttggttgatgtgcttctaggtgctaaaagaataggccggggatggtggcttaggccgataatcccagcacttttggaggccagggccggcggatcacctgaagtcaggagtttgagaccagcctgaccaacatggagaaaccccatctgtaataaaaatacaaaaattagctgggcgtgctggcacaggcctataatcccaactactcaggaggctgaggcaggagaatcgcttgaacccagaaggctgaggttgcggtgacccaagagatcgcaccattacactccagcccgggcaacaagagtgaaactccatctcaaaaaacaaaacaaaacaaaaaaaaagagtaacgagtgttagatattggtgggggtggcatcagaaggactttgtgtgacattcccaggtctgttctgagcgcaaaggccagatttagacagcgttgagaacccaaatgaggctctagaaactggtccaaacaatgtgcccataatgacacgtgtcaaaaccgaagaaggccttagtcaggggaaaaaagatgcaaattacaaagacctttttcagagccaccaccttctaaaagtgaacagaaggagcaggaagctgccaaagtgtaccagaacctcctccttcgacgctagaaagagtaacaggtcaagctccaacttgcaattcagttctattttgaagtttactggaaagcagaaaataagaagggatttgagagaggccggcagtttgaaggcaaggaggaactgaaataaacacattagacccaagaacacaaaagtcctagcagcttggacctgctatttctcgacagttcctccaggctcctcatgcataagccaatcagcaatgatgtgcatatttcagcaatgatgtgcataatattgatcttgaaccacagcgatcttcctagttccttttgccaggagaaaagatgggggtggccacacatttgagaaagaaagtccattaacattacccaagttggttttgaagtattgagacacttttttttttttttttttttttagatggagtctcactctgttgccaaggctggagtgcagtgacgtgatctcggctcactgcaacctctgcctatcgggttcatgtggttctcctgcttcaacctcccgagtagctgggagtacaggtgcccgccaccacgtccgactaatttttgtatgtttagtagagatggggtttcaccatgttggccatgctggtctcgaactcctgacctcaagtgatccacctgccttgccctcccaaagtgctgggattacaggtgtcagccaccacacccagctgagacacatttttagggtgtgtgtatgaccgagttttatggttgcaaacaaaagactccatgctgcccagttcaggcataaaaagaatgtcctgaataatgcaagatgatgtataggatgcttggacaaccaaagccaaatgtggaggctctgctgtgggtgatcatgtcccaaccacacggacactgaccagcacagaccctgtccctgctgctaatgagttcacactgccaccaccaggcacagacccaaatccttgaccgctgctggctgccccttttgccagaatggattctgtaccaggctagtttccccacataacttgctctttcaggaaatccaaaagtattgatacaaaaggtgtattagagccataagtgcatagagagaaaagcgggtacattaagctttgattctccactgcctgttgtaatagtttgttttcacgttgctgataaagacacatccgagactgggcaatttacaaaaagaggtttattggtctcacagttccatgtggctggagaggcctcacaaccatggcagaagatgaaaagcacatctcacatggcagcagacaagggaagagagagcttgtgcgggaaatttcccttttcaaaaccatcagatctcatgagactcattcactatcacgagaacagcgcaggaaagactcacccccatgattaaatcacctcccactgggttcctcccacgacatatgggaattgtgggagttacaattcaagatgagatctgggtggggacacagccaaaccatatcacctgtcattacttttttttttttttttttttgagatggaatctcactctgcggcccaagctggagtggtgtgatcttggctcactgcaacctctgcctcctaggttcaagcgattatcctgcctcagcctcctgaatagtttggatggcaggcgtatatcagcatgcccggctaattttgtatttttagtagagacagggtttcaccacgttggccaggctggtctcaaactcttgacctcaagccatctgtccacctcagcctcccaaagtgctgggattacaggcgtgagccaccatgcccagcagcctgccattactttcattagcaccaggcttcttgcatattttacagattgctgtcaatggtctaataaacaggtgtgttaacacatccagcagtaaagaaccggggccctcgaacctgcctgcctgggtctgaaccctgctccccagcccttacttgctggaagaccttgggcaaattattcaactcccatctgagaatattattcataacagcacccacctcatgggccagttgtgaaacttacagaagtcaatttaaaccaaggactgaacatagtacttgtaatatgagtttgtacaaaagtatcagttgctattgttgatgttgataataaaagctaaaataacattataacccccttcatggtggtagtttcttcataagctgccattaaagcaaagagctacctacttaatacaatttgctccctaattaattaattatatctaaatttcattgtattgtgtcattctacaaggaatgctgctactatcaccttgggctgctaaaaaaatgcccagtcactaaaaaaaattgcttagacggtattctctgtcatttctcccaacgaataggcagtttattattttttgaagaagtcttttggctgtgacaatggggcctcataacaatgaattgagaacaatcacttccaaacagcagctgaaaacaccccttggttgcctctgagtttgggggtcactgatcaagagggtgacttttctgggacctctgatctcttaatagttgtagttcaacaagagcagttgtggtacattcggcttcaccttcatcgtgggagaatgaccagatgcctacctggttttaaaccacagtcaggggctccggaaactgtccaagaagaaactccggtgccctgaaggcctctgatgagcaacagagttaccttactgactgatggacacagttaattcagctgctaactctcaaattctactgctgactcacaatccggctgcccatcactaggtggcccggaggcctaaggtgaaaaggatgttgtctttctctgggcacattttcagaaagcccatttaaacttcttggtggggcaagagggggcataaaagggggaacaagatcttccacattgcaatattcatgttttaattagcgagtgtccagaacctcatatcaacttgatttgaagggcatgtgtaagaagtatacctacaactccttctctgagccccaaaatggcccccaaaaacgctccgcacagctcctggggttgaagatcctggtgaggtgcagtttgttctcacagccaccgtgcagcccaggtccatgtgcatgattcacacgagaaactaggtgaatagcactcctgggggtgcagaggtatacagggcagaacctggcacacagcaccaggtccacgtgagggggtcctggcgcacacacacgtacacaaacacacacaaaccccacacacataccaaggattccagaattctgggcttaactcagcctagactctaccacattcttcattctgtagttagaggccaaaataaaactcgtgtaaacagattaaataccgtggtaaccaaattcaaaccaaacaccaaggattgggtggggggaggggaaatagtcttactttgaagcatttgggggtgtgggggtggggaagaaaagaggtaaagaggctctaaagattctaagacatcaaagttcttttcctgatttcccagtggaaacaggacagtttcttatactaggtctcccagtggatcaccatccaccatcttggaaggcagcccaactgactgagtcccaaggagacctaacagagatttactttcccaaacaaggaatacttcaataagggtgtatctacagttagagtgcttaattcctttccgagatgttttcctaatggcagcactcctggggagagtcagaagaatgtgtaactggtcaaatcctgaacctgatttgcagtccagcccatgttcacaatgctcgtatctgctgagcctctgacttctgcgaccaatataggccaagtgtgtctggagagataatacatatagccacactccccaccttttcctcaagactagtccagaccacaagctggatgaggtcaaaaactatgtctaatttctcaccattgtatgctcagtgcccaggctggtgcctgacacgcagtaggcagtcagtgaatacagcccaaagagaggtatggccacagtcatcctatttgtgcccccgggacctggtactcaaaaaagaagtaacatatctgatgatggtatacaggcatgcatcaatgccacacactgtgcactgaggggacactgggctggcttcacacccttcaaggactctaagcagtcatgctgggtacccacacatgagcaaggaagggggtgttctgtgtgttttcatagataatgcatttgtctatttgccatccattcatcacatggctaattagttcaactacactttcttattttttgtcatcatttttttttttttttgagacagggtctcactctgtcacccaggctagaatgcagtggtgcgtggtgcaatctcagctcactgcagcctcaacctcttgggttcaatcaacctcagtgttcggagtacctgggactacaggtgctcaccaccatgcctggctaatttttgtattttttgtagagatggggtttcgccatgttgctcaggccggtcttgaactcctgggcttaagccatccacctgccttagcctcccaaagtgctgagatgacagattttctgtattgtagatgctctagcattaggggttttatagacctgggtaaagacatcccctcccagttctagcccgttcttagagatagcaaagggctcaaccaggagcaagcctctcacatgcaaaccaacaaacccagagtctataccccctcagccatcaccatatctaactctcacacaccaagccaattttcccccgccctaaaccaacctggggccaggtagcaggcagctagagacccctctagagcccaaagccctcctgaaattattcaagccggtcaatcccaaactgtttgccctgccttgcctcacctttcctgtgggaaccccagtaaaggttctggcctagattttctccttactcctgtcttctgcctccaaaccaaaaaaccagggcctcctgctgtggccctgcaagcatgctgtgcctcttctttctagggaaactgagtcacactaaactttcaagggcattgacctcactgtgatgtcacccagacatctctatttatttatttggtgggctttatttctatttatttgacctcgctgtgttgtcacccagacacctttatttacttattcatttatttggtgggcttcatttatttgtatttattttttagagacagggtcttgctctatcacccaggccagagtacagtggcacaatcatagctcactacagtctcgacctcctgggctcaagcaatcctccagctttagcctctggagtggctgggaccacaggtgcacaccactatgcctggctatcagacatctttataaattaagacccaggcacaaaacgagacggacccgtggatgagtctccttgtaagcgccttgctttctccgcttcctcccacactccactgggcacccacaggaagccctgacacacataatgagaaatgagcaaaagggcatttctgcaaagggagatgaaaaacaaatcttagaggagtggcgagtgtcctggttaaggctatggagccaggcagcctgggtttgcttgaaggtcacccctgccaccacctcctcactgtgtgtaccagcgcagcccctcaccaccctcaactgccgtttgctcagttatggaacggggaccaggacaacacaagatgctgtgagattaaagcgcatgaatacccaacggggccggcatgtggtgagcactgtgtggacggtaactgcgatgattcctcactctgccttctccaagggaatcagaactgcagaccccccgcagagaaaaacgatcacaccctttattcagcacttcccgcgtgtctgacacacagcacccacagcctggggtataaacaccaaaaaccaccctcacaggggcggaatgatgttcattcccattttgcagaagggaaaactgaggttcagagaggttaagcaggtttcccccaaaacacaaagctggaattggtgcgtgcagccaggatttctgactccaaaaactctcctctcctctccctactttcaatctcccccatttctgatcccctcccctccactgcaacacatatatattgagtgcctactgtatgcgaagagctggtgcaggagttgagaacacagcagtgagcaacactgctggaatccgagtctttatgaatcctacaggcagcaggaaagaggtcattgaggggtaatctcagaaataaatggaggccgggcgcggtggctcacgcctgtaatcccaccactttgggaggccgaggcgggcggattgcctaagctcaggagttcaagaccaccctgggcaacatggtgaaaccccatctccactaaaaaatacaaaaaattagctgggtgtggtggcacgtgactgtagtcccagctactcaggaggctgtggcaggagaaccgcttgagtccgggaggcagaggttgcagtgagctgagatagcaccattgcactccagcttgggctacagagtgagactctgtctcaaaaaaaggaaaaaaaaacccacagaaataaatggagagttcagatggggatgagagctatggaggaaaaggagaagctgctgtggtgagcaggaatacgagattccatttgctgtgcatgcagtgtgtcagacacacgggaagtgttgaataaagggtgtaatcatggaatcaaatggatccctgatcatggatcaagaatcacagacagcttctatggggaagaacattctggaaggaacagcaagcatgaaggtccccaaatgggacaggactggatatgtttgaggaactaccagaaagtcagtatggcagtgacacagtgacaagagaaaagcaggcaatgagaggagagcagaggtcctaccaagctcggccctcccgacaatttgggttggatcactgtttgctgtggcgctgtcctgcactctgtagaataagatgtttagtggcacccctggtctgtacccactaaatgcctatacagctcccgccctgtcctgccaaccaaaaatgtctccagacattgccagataatgcaccccacatcccttccgggataaactgtgagactccacggcgatgctatttcagggacaaaaagaagcctgtgcttatggaacagaaactggccttgccacgacctcattagtggagaggatgggccccactcatttgggggaattatttggggaaaagtataaactccctagctcagcagactgcgagctccccatgaaaggccatgtgtcctggttcctcacacggggcctgagatgcgaaagcacagagggtacctgggagggactgagaaaggaggggactgtggggtccagtgggcacatccctatcacaatcagcctgtgcagctaggaggctgccacgcacatcggcagactctggctttcaaaatgaccctggaggagctgcggctcctgctggcatgtcaatgtcaacagcctttaccctccccagctcctggaatgctagaatttagattctcagttctgcgggagagcaggacagatttacggaattctcagcggctgcctccaccaggggttgccaggggcaagcatctgcaccgtggtgaaacatctctttgaacaaggaagtgagagtgagcatgtgcattaactatcggagatgtgggggagaggaggaagccatgcaaatgagcacggacagccagcagagacgtttaaccttggtgctgctagagtacccacaagtgctaacgaggtggctggtgttgctttaataatcaaataataaccaggcaatggtttagatccattttggacccttcacaattcccaggactacacttaacagtttggtaagactttatggatagcttgcaagtttgaaggcgtaactttgtaagctcagttttgaccctggaggaaggaggtcatgagtaagatagggacaccaaaaagaagtcaggtggtatgctttttccattgactcacagtcatttccaggagaaaagaaaacatcactgtgcaaggctctactgactctcttaatttatcctcacaacagcctcgtatagtaaatattatcctattttacatgggagaaaaatgaagtttagaagcttgggaaatctggtcttcattatttggctactaacccttagtttccatcacaattccctcattctctcagctctagtctagtctggatccttttgcagtcctgccccaggaccttggcacaggttgtttcctgtgcctggattactctgacctcccttcttcacctggttaacgcgacttaaccttcccattcctgcttgctcatctcccagagcctcctctgggctttttccaggccaaactactctaacaaaagctctcttagcatcaagactgctgcttctgcatcaggactcttcaaagttacaatttaacaaagaagccggcgtgtgctagttcaccaccgtaggcatatgcgtcagattcaagatggcttcaaattctttgacatgcctttatcgaaaggtagtgtcttattcccctcctcttgaagccaagatggccttactgactcagctgaccaattgaatgcagtgaaagtgatgttctgggaattctaagcctcaatgataacatacatacctttgcagctcctgctggacctcttagaatatttactctggggaaactccctcttggaacccagccaccatgtggcaagaagcccaagacacacaggatagaccatgtctgatgcagccaacagctccagctgagctccccccaacaaccctcaccaactgccaggcacgtgcatgagacaccttgagcaaccaccacagccaaaccttcagatgatcacagcccactccatatgtgtcagtaacatatgcagaaatccaagaaagaaccatccagccacgtctagtcagcccacaaaaccttgagagatgatactaaagcactgttttagtcattacgttagagaactatttgttacacagcagtagatgatcagaaccctgtaagatccagcataatgaacagttgttcagcttgtacacaccttaggcagcagctaggactagatgcttaataaatatattatttatggattagacaaagaatgtagtgtgtgaaaagattaaggtggaggctggatttatacccgtttatataactccaagttcctcctctcttttctttttaaccatagcctaatgctcccttaaaaacaataaaaccattttatttccagcctatcatatttgatgcaggtttgggaggaagaatacaatattcagacagagccatgtcacaacaaaatggcagctttggttgcttgtcatgcctggaaaaaagttcagagttaaaaaaaaaagtagcttgaggctgggtgtggtagcttacacctataatcctagcacttttggaggctaaggtgggtagactgcttgagcctaggagtttgagaccagcctgggcaatatggcaaaaccctgtctctacaaaaaatacaaaaataagccatccatggtggtgaatgcctgtagtcccagctagttgggagtctgaggtgggaggctcgcttgagacctggacattgaggctgcagagagccatgatggtaccactgcactccagcctgggtgacagagcaagatcctgtctcaaaaaataaataaataaataaaaaggctgttcttatgtcattacactcattgacagcacaggggtctctatgccctctctgcagttatagcatgagcgctgctgtaggcgatatctaaatgaatgggtatagctgtgttccaataaagctttatttacaaaaacaggcagtgggccagattcgcccaaccctagtacacagcataatacagtggtctttcaatttagcagtaagcacgcagtatagggaaaagttaatccacggacctctttttccttctgtaaattgaaagagagggagcctgcttcctttgatttgagtatggaatgaccttggctagttcgtgaagccatccatggtggtgaatgcctgtagtcccagctagtcgggagtctgaggtggaaggctcgcttgagacctggaggttgaggctgcagagagccaggatggtaccactgcgctccagcctgggcgacagagcaagatcctgtctcaaaaacaaaaacaaaaaaagatagactgctcttatgtcattacactcattgacatagctcaggggtctctatgccctctatgcagttatagcatgagctatagacaataggtaaatgaatgggcatagctgtgttccaataaagctttatttacaaaaacaggcagtgggccagattcgcccatccctggtacacagcataatacagtggcctttcaatttagcagtagccacgcagtttgtaaactcaatgaaacaggcaatgcctttgactgaaatgactcttggtactttaattttgcattttagacaacatctttcactgcattttcacatgctgaaatgggttcagatttctaaaatataagaaaaagttacagtaaaacaaaacaaaacaaaaaacacttaatatagggaaaagctaatccatggacctctttttccttctgtaaattgaaagagagggagcctgcttcctttgatttgagtatggaatgaccttggctagttcatgaaggcaggaacattccatgagacaggagttaggaaaccactgggtcactcatagcaaggataatttcccctcactggccctcaaagaactatttgttgataaataatgaatccaaaatctattggaaggagagtaatccactcattactgttagtccattcaatagggctcaatgactgggtgaagtttattcaaagcagcaaaatatcatctaatggcttgctcttttgtctttgtaggatcaagcctttcatcttagaaagtgctacccacgttatccaaaactagcaaaaataatttaattaatgtgtatataagccacaagtgcccaaattatagcttgtgcccaaaccctaggtaatgctagagttatacacataattttttaatttcgtattttcaagaaatgatagaccctataaattatatttttaaatgagccaggaagtaatggctaatgttaattcttaggcaacagaaacgtgctacgctaattattattagcaataatggctcaatgggtaaagaacttctgaactcacaaagcaatttttaaaaactgtattgcattgtttcatacctaaaagagtcccagggttaggtaatttttttcattttataggtgaataaagggagacgcagggtaggtacctgctcatagtcatagctaagtagccaggactcggttgctatccaaggcttcttctatctggaacacttcaagagaacaaggcaactcctctccaaatataattaatatgcaacctctcttcctattattctttgtgaagtttagcactatccaaaaaaatgtactaggctaattattcagatttttttttgcgaagggtgcaaatgttctttctattgaatgtgtgtgcatgtcatttattacaccatatttttaaagggagactaatgcccaataatgaccccagggcttagctttgaagaaaattccaaccaaaaacatcaccttactgtctgaatctgtctccatttcagcaactgaatctttgttgctggactcaataaaacacacttcagatttctaatgcttggatgggagatgagttggtccaagctagatcctcttgtctttgggcccacaccaaacaccaaacacgagtcaaccactcttgcaccaccacaggtatgcatgtattaatatcggcttcccttctgccacagctgtgacttgtgttgggattatttctactccgccagcttgtttaccttattagagtaaccttacagctcaatcattaggactccatggagaagccatggaaaatcaagactcagacatatatttcgatcttaggagaacatgcctgtgctttgtctgtcattattctttttatgggattctaaggcagtctaagataggagaatcactacaaggctcctgaaaaatccctgccaattaaggagtgacagactgcattttccaaagatgaccacagctatatttcctatcccatatgctcttctgcaaggtgactttgccacccccatcccttcaagaggtgggacttatttttcccgtccttagaatctggacaggccctgtgactgctttgagcaacagaatatggcaggagtgatgctgtgccagttttaagtgtagcccttaactttatggcagcttccaccttcctgcctgctggaggccagccaccacatcagaagtgacactaccctgaggccatccagctgtgagacaatcaagccacaggaagatgcttgatgctacctggagagaaacagacagaggggtcaaggaggaacaaagcaccagacagacggacgataaagtcttagaagtggatcctccagccccagtggacaacacatggagccgagacaaacctcccagcagagcccttcctaaggtcctgatccacaaaattaggaacaaaacaaaattaatgttttaagccactcagttttcagatagtttattatggaataccagagaactgttaacatttttttttcaagaccgagtctcactcaatcacccaggccagaatgcagtggtgcaatcttggctcactgcagccttgaactcctgggctgaagcaatgttcccacctaagccttccaagtagttaggtctacgtgtctggctagctttttttttgagacggagtcttgctttgtcacccaggctggagtgcaatggcatgatctccactcaccggaagctctgcctcccgggttcacgccattctcctgcctcagcctcccgagtagctgggactacagatgcccaccaccacacccggctaattttttgtatttttagtagagacggggtttcaccatgatgtctggctaactttttaatctttgtagaggtggggtctcgctctgtcacccaggctggaatgcagtaacatgatcatagatcactacagcctcaacctcctgggatcaagtcatcctcccaccttagcctcctgagtggctgcgactacaggtgtgtgccactatgcccagctaattttttaaaatttttcatagagatgaggttttactatgttgcccaagctggtctcaaacccctggactcaagtgatcctcccactttggtctctcaaagtgctaggattacaggtatgcaccactgtgcctggcccacaaattttactttattatttttttttggagacagagtcttactctgtcacccaggctggagtgcagtagtgcgatcttggctcactgcagcctccgcctcctgggttcaagcgattctcctgtcagcctcccaagtagctggcattaaaggcatgcaacaccacgcctaactaatttttgtatttttagtagagacggggtttcaccatgttggcaaggctggtctagaactcctgacctcctgacttcaggtgatccgcccacctcagcctcccaaagtactgggattacaggtgtgagtcaccatgcctggcctcacagatattttttattgaaacacaagttagatcttccttggggtcactgcaaatagttgtatgatttgtgtaccgcaaagtggcaaataggggctgaaatccaaccagtgctttgctcaccacgccctgcatcggtgagctctggtcttctgctaagaggctgacttttttagccctgcaaagtccccgtacagactagcagtacgtcgaagcacagtcatccaaatgtgggaccttcaataacgatgacttaagaatttgacggaacaatgtgattatcgttgccagaggaggtttttcttccctgctaatatcctggacacctcgctgggcttgccaactttatctggtcccttcttcctctgccccaagattccacccttaaactggagtaggtgctttcactgcccagtggggccgcccttctcggcaggcctccccagcagcgcctgatgtttcatctcatgtgaaattgccccaaaacacaggatcagctctgcactgggccatcactgccactcctcaggggcagctgagtctcctccctgtggccttccaacaatggctggcagtaaggctcattcagaacccattaaggcgattgttttttcctcaagggcacttccttgagggctgaataccaatcagcctgcgatacaaaggaggggccccctgtcatccttgggactgtgcagtggctctgtggggacaatcccacgtgctgtcctccctacaacctcactcccctgggcttttgtgcaggagtcaatattgattactgttatttctttcttttttctcttttttttttgagacagagtctcactctgtcaccaggctggagtgcattggtgcaatctcagtcttagctcactgcaacctctgcctcccaggttcaagcgattctcctgcttcagtctcctgagtggctgggactacaggtgcatgccaccatgcccagctaatttttgtatttttagtagagacggggttttaccatgttggccaggatggtctcgatcccttgacctggtgatctccctgcctcggcctcccaaaggattactgttatttcatgagatgactacaggctcatcatgccacagcagtggtgacccaggagcaattctcatagtataagcaagtcctatagcaaaatccatgggaacctataggaccgtggccaaagtcatctctgcctcccaagaaggggcaggaagtcctattggcctcatctaaccatttatgcctgttcttacaagctctcaatctgtccatccaacccaggagacactcggtcatcatccaccctttacttcttctgaaaagctgatgcaaataacttgggctttaaaacccaaaaagatctgtgtcccaatccagactctgccacttcttagctgtgtgatgttaagtgactgtctaaacttctctacttcctcacctgtcaaatgaaagcaaggacaccttctagcaaacctgagagaactgaacaagataaggccaagtaggctacaaatggcacccacaagttattccattcggttcatgaacaaacctttcattacaaattccaatacttatgtatttatgctgatgtatgagaagacgataggcttcatgaagaccatgattttatggacattatagcttaggttgagctaagtaaaaagtgagtggatgcaaagaaaaatatgaagtaaataaaccatgaccggggagtgttatgtggatgctgtagaaacaccaagaaaataagataggtggacacagccgggtgcggtggctcatgccgtgatcccagcactttgggaggccgaggcaggcggatcacgaggtcaggagttacagaccatcctggtcaacacggtgaaaccccgtctttactaaaaatacaaaaagtagctggctgtagtggtaggtgcctgtaatcccagctactcgggaggctgaggcaggagaattgcttgaacccgggaggcagaggttgcagtcagctgagattgcaccacggcactccagcctgggtgacagagcaagactccatctcaaaaaaaaaaaaaaaaaaaaaagatacgtggacacacaccccgacactgtaccacatggtaggtacagacatcaccaccacctggcacattttaggtgctgaatcagcatctgtttccctctcctgtaacctcctgtggcatcagcctccacccttgaacttggctccagcctcattagggtttggccaagccttagaagttggaggtggactccctgcagtcttggggacggttcccaacaccagggtggtaaggaggaatggtctttagctttgcaggtcatgatttcccttgaagcacctcgtaaacagcagggctggcccacctcaataaaattttactcagcgcttgcaattcccccaacttccttccgtagccagatgctgccctttgctgtgtgcttaactccccactgacaactgatggcatttagatgcattgtagggtgagacccagaaggctgctcattaacatcgtctatatattttaagagccaagaaaccatttttcttggacctaccaattatataggacaccatgcagctcccttccaaatgtcgacccactctagatagttgaggctaaatcaaccaagaaggtgtattagctttcaccagacccatggacaaataattcttcttacacttctaggtagcaatgtaacattttgcttcccagaaaccaaagctcacatttaaacacatggcacccaagcccatatttcaggaaaggccctttgttaattgttcataggaaagtaatccaatagggtctccaacttcctgctgctgttcattccacctgctgctacacctgggcttatttattccaccctgaatggttttctttcccccagcacacagccaggctggttcctgcctccgtgccttgcccaggctgttccctgagtcctgaatgcccttcctgctccttcctgcctaccaaataccttaaatacatccttcaaactcagctcagatggcgctccctccaagaagccacctgtaacttccagaaagttaatgtcccgccaccctgtgccacttcctacctcgtttagcacgtcatgtggtaccatgaccacttccatgtctatacgtgtattttgccacgagatctgttcccaatgttttgtaaggaacaaagtaagtgagcaatgcatgtctggagaatgaataaattcaggaatcccattaatgacagtatctatctgtttaacaaatattcatggagcacatactaagtgctagggactgaggataccacattaaagaagaagaaaggacagattcctgtcctcatggggtttatgttctagatacggggagaaaaagttacatacaaataaacaagattattttagatagtgataaatttatgacaacaataaaacaaggcaatagcattacggccgggcacggtggctcatacctgtaatcccaccactttgggaggccgaggcagatggatcacctgaggtcaggagttcaagaccagcctggccaacatggtgacaccctgactctactaaaaatacaaaaagtagccaggcgtggtggtccagctactcaggaggctgaggcatgagaactgcttgaacccgggaggcagaggttgcagtgagctgagatctcaccactgcactctagcctgggaaaaagtgtgagtgagactccatctcaaaaaataaataaataaacaaaacaaggcaatagcatagagcagagattagcaaactttgaccagtgagtcagatccagtctaccacctgtttctgtaaataaagttttattgacacatagacacgcccactaagttattgcctctgactgcttttgcccaacaatggcagagctgagtaggtttaacagagaccctatggcccataagcctacaatatttcctgtctggccctttacagaaaacattcacagacctctcatatgactaaggagagaggaaaaactttaagtagggtgaaaagggaaggccactgtaaaaagatgacatttgagtgaagaccagaatactaagaaggtgtcagccatgcaaaaatatagggtaaagcatcccagatagaagaaggaacaagtgcaagggccctgaggcaggatagagacagagaaaggagagtgtggcttgggagtaattaggtggtgaatgatacaaaatcaggcatcatggtaggcagagcccatgtgatggggaatctcacaagctgtggaaagggcttcctgctaacactcatgaataattctgaaaggcagcgaaggtatctgggatttgggcagcaagtggtgaaatcgtgtccacggaagagaagggacgatagcaccaccatcatgaatgaggaagtctaaaatgttgacgcttggctcaagacttctttgccaccacgaacaacatctccaagtcaagctctgccttttgttgttgtttggtttttctgagacagagtctggctctgccacctaggctggtgtgcagtggtgcgatctcgcctcacggcagcctcccaggcttaagcaatcttcccacctcagcctcctgagtagctgggactacaagtgtgcaccgccgcacctggctgatttcttattttttgtagagacagaccctcactgtgttctccttgctggtctcaaactcaagtgatcctcccatcttggcctcccaaagcgctgggattacaggcgtgaaccatcactcccagcttcaagttctgcttttcaaatgcgtcaccccacatccccaacacaaggttgcccaaatgtgcacagaagatgcttctacaacagctgaatcagcatccacatgtatcctacccacactcttttttgtatttaaaagactcactgtttcttctcttacattcgtgttttaaaaggaaccattagttcactttaaaatcacaggtttaataagccagctacatacatttcacttaaatacaaaaaggtttttttttttttaaaacgttcacctgtctaccacctcaaatcatctcagccacactctgggaaacaattgtttagagttcaaacctataggaacctcattaatttcaatccacacctaacttctgacagtactaccggagaggcgggggtttggaggacctttttattttttatttttttgagacagcgtctcactctgtcgcccaggctgaagtgcagtggtgtgatttcggctcactgcaacctctgcctcccaggttcaagcgattctcaccctcctgagtagctgggattacaggcacacaccatcacgcacagctagtttttgtatttttactagagccagaggttcgccatgttggccaggctggtcttgaactcctggcctcagatgatctgcccgcctcagcctcccaaagtgctgggattaaaggcatgagccactgcaccaggactggagtagcttttgaccaggacagtgaggacagaggacagcttgagggtgcagcacaagctctggcggcagagcttacacctgaccctgtcactttccagctgtgtgctcttgaccatgttaaatctgagagcctcagactcctgtctataaaatgagccaggctgaggggctgttgagagaattaagagatgcacctgacttggcccaggacctgacccatgctagatgctcaataaatggtcacagctctgattacaaatgcataattatttacagtcataatgatgatcatcaaaagtcctttggtctctccaaaagtgctaaaagcatctcttgtcatcaatgtgtctgagcttttgagacatctgtagccgcagcccactcaccaactgacatccccttgccgccaggggtttcgggaagctttcggccgtgtggtagttttccactgggttcaccaaactaggtctcttttttcttgctttccttttattttttgtttccaaaaggttcctgattaacaatctttcagagagggaggaggaaagaaattacagcaaatgttcctttactctggtccctgctgggctgggaggctgctatttcagactcaatcagctacctgcagggtcaatggatgaaatgcctccccatagggatcaggaggatgcagggccattgggaagcttccacagggacctgtggcctaaaaaccccaactgctcaaaagactcagggacctcaaacctaaaggggatgggagcccaatttctttaagaagcacccgtctttgaaaagcagcatttctcactctacctctgcagggggaaaggagcaacatacatcccctgaaagtaattaccttcaagttgtgaggatcaaacgccatccttaactggagataatccgaaattcactttgaaaccccctctgtccaagcaggcttaagtctctaactgcttaattcaagaaatcattaaaaatggtctttctttccttgccacaaacagagtaaggtaagagaaagacagccaagaaacctgttgaactgctgatgagaaatgcgacagcaataaaatcactggcccaaaataattctgccgcaggttaactcaacggcaagtatgttgctctcacctccaaggatggcgaattcttaagttcttttgttccaatcaccatcttccagaaatggctacattaagttgtagggcctcatgtcaaacaaaagtggcagcgaggatggttacttctgtgtgttaacttgattgggccacggggtgcccaaattaaacatgacttctgggtgcatctgtgaaggtgtttctggacgagattaacatttgaactggtgaactcagtaaagtacatggccctttccaatgtgggtggttatcagccagtagatggagggcccacaaagagggagagaaagaaatttatttttcttgcattactgcgtgagctgagacatccatctcaccttctccagctcagaccgggatttacattattggctcccttgattctcagacccttggcctgggactggatttcatgaccagctttcctgggtctccagcttgcagagagtagctgcagggacttcccaaactccataatcatgggagccaattcccataataattttttttttttttttttttttgagacagagtcttgctcggtcgcccaggctggagtgcagtggtgtgatcttggctcactgcaacctctgcctcccaggttcaagtgattctcctgcctcagccccccaagtagctgggattacaggtgcccaccaccgcgctcagctaatttttgtatttttagtagagactgggtttcaccatgttggccaggctggtcttgaactcctgacctcaagtgatctgcccacttcagcctcccaaagtgctgggattataatacacaggttgagcatccctaacccaatcatctgaaatgctccagaatctagaacgttttgagtaccaccatgatgctcaaatgaaacgctcactggaacattttggatttcagaatttcagattacgggtgctcaaccagtaagtataacacaaaatatcccaaatctgaaaagatccagaatgcacaaagattctggtcccaagcactttggttaagagacactcagcctgtacatggttctgtttccctggagaaccaaactaatacaggtgccttgttcaaaaattataaatttcaagatggcggcagcagaacattaaaccaagtgcaggcccattcctggaggggcccccagtcttgcctgcttccctttccagggtgcctctcatggctcctctccctgtattttcccaacctaaccagaccctatgatctgacaaaggaattctttttttccccaccctaatttgtgaatgtttacatatggtcttccagattcacaatccatgaacccccttgcttgcaaaaaataaaatgacataaaaacagagctaaccagccacctcagggatcctcaaaaccttttagtttgtagaccagaacctgaagcctgagcttcttttaattttcattatctcattctaagagatagtatctaaagtaaactggggctgaacagcactcataacttagctgaaaaaagaaatgtagaatgacccaaaatgtataataaatgcaaaatgagaaaagctaaacatgaaaaagctagtaatttaaaatatgtataagtaaataaaaataaaaccatctccagagcagaggtgggcaagcattttctgtaaagatccaggaatacacatttttggctctgcagcccataaagtctctgtggcagctactcagctctgcagtggaatgctgagtagccacaaaaaacaacacatacacgagtgggcgtggctgtgttccaataaagctttatttatataaacactgagctgactggatgtgtccttcaaggccttattttgctgacctatggcttagagcggcgcttctcaaacttcacgtgcacatctatcgcctgggaatcttgtgaaaatgcaaattctgactcagaaggtcgggagtggggcttgagattctgcattcctaacaagtccccaggggatgctgaggctgcgtgtccaaggaccccactttgagaagcaaaagagcacccccagaaaagaaaagaaggaaaacctactaaagaacccaaatttaagaagcacttagcagaacacagtatagaaaagtaatttattttctcatcaccaaggaacagagttatgcaatttaagtgtatcttcagaaggggaataccatgtcattggtgatcaaggatggagttaactatcattatcagaaagcaaaatgctacaccgtttttaaccaccgctgtgcattttctggtggcagttaacacggacatatagcgatcaatgcaggtaaacgaatccattcgaaggcaggccatggatggtaaatcacgttgtccaataaagttgctaaattagcaacagcgtgacacagagcattttttataaaagcgaatcctttttggaaggagatggactgcaggggtgtgtggctagcaagactggagggtggaagggagaagcagccatggctgcggatccttctggggtctggaagctctgaattttgctgggggatataatgtgaaaccggtgtggaggcttttcctgtgtgttatcaaggccccagtgagggtctgttgcccacaggcagataccaatggttgtatttcacacacagcggtatttaataaacctcttcaccatccagtttataagaagataaaaaaaaaatggctggttccactcaaacactgctggcaggaatgcagaatggcacagccactttggaagacacttcaacgatttcttaaaaagttaaatataaatttgccatgtgacccaggaatcctgctcccaggaatctacccaagagaaatgaaaacatatgtccacacccagacttctatgcaaatgctcatagcagcgttattcacaacagccccaaaagcagaaaaaacccagtgtccatcagccagtgaattagtaaataacatgccgtatatccttacagtggaatactattcagcaatatacgactacacatatagacctcaaaaacatcacgtgatagccagtgcaaaaaccacatactgcatgcttccatttatataaaatatccagaataggcagatctatagagacagcagattagcgggtgcctggaaatggactccgattggcataaggagtcttatcagggttatgaaaatgtcctaaaactagattatggtgttggttgcacagctcagtaagtttactaaaaattattgcatagaacccttgaaatgtgtaaattttacagtatgtaaatcacatctcaataaagttgtttaaaaaaatggttcccattatatctttccctttttcatcgctcacctctctagtccttaaataacatagagatcctgtagactgcaataaacccaaagacacgctggttgttctagaggaggctaaagcaagtcttccgacccaagcagatacgctggagatggcacatcaattgtcttgtcaaaagaggaaaaaaaaacacgcaagggccacgtatttgatttttacagtgaacgatgaattcatctgtggtcagagcatcactcgggcagagacgggcagtgccctcgaagatgcctccaaacccacagcctccaatcccaacccaatcccagcccaggagcttccaaagacctaagccctgaggagaatgggaatcaggagtgacggtaatgatgacaaaggctcagcccatcagctgtgttagaaaaaaaaaggaagagaaaacttgctaagtggagagccaaattcacctcgccccacatgcagccacgcccaaaactcccatgcccacccaacaagccatgtcttttgaaccatgctatcaccccgaaaagtgactcttttgaggtcacactctgatggcagaaaaaactcccatgtgcttggaaggaaatgaaaactctagtgatatacctttggcttgcctccagatggagaaagaaaatcttaagaaatgttgagctattgcaacatcccctttttgggaaaaacaatatttccagcagatgggagaatcataaaaagtaaggaagcacggtcgggaagggttgcctagaatgatccacagtgtctgcagtggccatcttcccccagcccacttcagaatccacaaacacgcatgatggtagcagccagctcagggtcaaagacagaacttggggctagaaactaggacttgggatggcccacaagtgggtccagccatgaccctggtcatctgggtgctgggtagttgagcctaccaggtacagaaggaaccccgccgaggaggctttggggtctgaagaatggaatttgggctccagcgagggacttaacagcatttcctctatagcctcaaaggtatttgaatcaggaacactagcttcacagccagaggcctgataatctccttctcccctttcattgaaaaagaaaatatctaagatactggagaatacagtaaaatccttaactctgttcccccacccccgcttttttttccttcattcctagcggcaaggctggataagcttatcaagagcaggcaaactacatcttagctctgatcctttcgagaaatccatttggcgcctttaacgtttcatttggcagattgaatttcgggcatgtatttatgggactgggtttgcccttaatagagtattgcataaatcccattacagtatccacttcagtgtgtttggggttttctaagccagggctttatctaagtggacagcatgggaatgacccactctggctcagaaactcccgcctctgccctggaaccaacctttgcagattgcctccatcatcatcaatgtcaaatgatgttttgggaaaagttctgggaagggtcagaatgaagcatgtcccatccacaaagaaggtggtgacaagcgtgtcatcacctgctagtaaattacaggatttccttccaggaaccacctcgctccacatccctcttccttctggcaacagccagagaaagtctgttatccacacaatgcctttctgtctttcgtaagtatgcaatgatgaagatgcattacttgtcatttctgaaaacaaaacaattattaagaaaagtgagctataaacaaaacagatcaggcttagcaaccctgaataagccagttctctgtaaccctcaagttaatcatttaaaaaaacaatggggccaggcacaatggctcatgcctgtaatcccaaaacttggggaggccaaggcagaaggatcacttgaggccaggagttcgagaccagcctgggtaacatagcaagaccccatttctacaaaaataatactgataattacaaaattagccaggtgtggtagcacacatctgtagccccagctacttgggaggctgatgtgggagggtctcttcagttcaggagttcagggctatagtgagctatgactgcaccactgcactctagcttgggcaacagagcgagaccctgtctctaagaaaaaaaaaaaaagaagaagaagaagaatggaattagcaatcccaacaacacaggtgtggagttttaatgcagatgaaagaagaaagcatgcttagctcacaggaggtgctcagtgacgcttggcccatgcactcatggcacacaccttagttcatctttcctagctggctctttcttggcagggctggacaggccacttacttcccaggcaacaaggcagagatgcctgtaagatgccttctgcgtacatggttcaggtccggcgtggcacgcaccatatgcaagagtcaggggttacaccaggctgaagtgtcagtacattaagaaccatttccttcctcctgggatctgtcctggaagcacgcacagaactctccattcactgacttttcacataaatagactccaaagcagaaatgcatggaaaggggctgacagcgggcctcagagccccacataaagctaaaggaaagccatttggccttctggaaccttcttttaccaaggcacactgtcccctcaccccctacaagaacccagcaatccattatctggtcactttcttctacgacacaagcaagtttttaaaaaaggcaacggcagctgcagtaaacgaagaagtgtacgtgatgagggccctttgggctatttcaggctctgtccctgcctgaaggtggctgtgggtttggttacatctaagttgggcctcagagcttgtgaaggtaaatgcttcctgatgagaaggaaaaaaaaaagtctaaggagtcttcattgattcaaccgacatctacaaagttcctactatgtgccaggctccagcaggtggccaaagggaacctggtatactaaagacctggtgccctctctccagggctgaatcctccaaggattctctcattgactttattttcatcttacatcacccgtgagcagctggggtagatgttgtgcagttactgaagaatttgtatgtactataggaggcatgaagaatgcatgactttatttacttccaactaaaggcaggaagtagtagtaatgtctccactgatatggtttggctgtgtccccacccaaatctcaccttgaattgtaataatccccacatgccaagggcggggccaggtggagataactgaatcatgggggccgtttcccccatcctgttctcatggtagggaataagtctcatgagatctgatggtttaataaatgggagttcccctgcacatgctctcttacctgccatcaagtaagacatgactttgctcctcgttcgccttctgccatgattgtgcggcctccccagccatgttagaacttcgagtcaattaaatctctttcctttataaattactcagtctcgggtatgtctttattagcagtgtgagaaaagacaattacacggtctaagagatgagcatgtcaaggcccagagagatgaagtgacttgcccaaggtcatacagacaggaaggggtaaagggatttgaaccaaggctgtctggctccagagtccccactcattgccatgatatcgccttgctttcaggagtttgctgtggtctgatctcagcactaccaccgtggctggcacatagtaggggcgtggatggcacatagtatgggcccaggcagcattggtgaaactgaatttgatcatcttatttaaagctactgcaatcacattcagcttttaagctacgggttgggaacgaggtcattctataaaaatggaaagcagaaatttaccctgaggaattttttagagttagggatagaagtccaaaagggaatctacttcaaatgaccagagagctaagacatgacctcaatacaatatgattaaatgagatgcagtggagaattacataacagttcagaaacacaatttacatctccactggtgctttcctttttattaaactagcatttctgttacgctgacaatacagaagagcaaggtcttctggaactgtttggcttacacaggcgtgagagaagtgaagacttattccattcactgggtaacatatgggtttcccagagagaaagtccacacagccatgcatgtgaaatgggtgatgataacaatagtaattgctgaccctcttgagtccttcctgggggccagacctgtgcgaaatgatccacctgcattagctcattgaatcctcatgagaaccttctgtggcaggtaaacagtatgggtcccattttacagatccgaaaactgagtgaagccgagctctaaactcaggccatctgtctgaggctctcagtccttagactacatttggaacactttactcaaagaacaccaattatgataaggaaaaaagaaaaaaaacgatgcttgccaaaatccagacatctcagacatgaaggcaagagatccggaaccatctgggcccgtgtagggtacaagctgccggcttcccactttaataccattcccttgggctaaactcccacatgtggccacagaaacccacttttcaaacccggcatcctccgcctccaatcgtatttggctccacagaagccaagaaggcatttggggacaagcaatctttatctgtaccaaatgtttattggagccactccaggaaatggtcccacgtgaagccaatgtgcacgatgtcacccacatctgcttggaatgcacttgtatctacattgcaatgctcagagttacatgtctcttgaaacgccaccctgcacagctatcacctggtccaacaagaataacagcctactgttcgtggagcggttgtttagataaagagaagagagggaaggaggaatcagatcgctccttcaaaatacctctccccatgcaccaattacagaaaattgttctgggaggcaggaggagctctccaaagtgtttaggaacacaaatctggcaagtttaaaaaatacagtgaagttcactttcctgaactccagcatcatgtcctcaaagctaaatcatactgagcagtatttgcagcaaagaggctgaatactggttgccgcacggtgcagtcagcctttctggacgggatcatacatacttaccaacagaattcttgaggtttgcagaggaaccaaaattacaaactatcagaagaagaaaaaccctcacatcaaatgcgaatggaacattcaggaagagagaaaggattaaagaaatggaaaagacgaaaacctttcccactgggtagaaggaaggagcactggtttccaaaaccactaaggggcccttaatggccagagagggagaatatttaaaaaggtctgcaattctagaatttccccacagatgagatcaggcatctgtgagacgaacctaatcgcagaggaaaacaggaagaagatgatgatgttaatagcgctctcccctaactttggtttggtggctgacccaacccatagcatttttatagccattatttcattcaatatggtaattgtgaaggtaagagatagcatgaatgaccactactcttgtacttcaccaaaaaagcctattgtatgggacactgatgtcctcattggggcaactatggccaaggtaaatgttaagtggaggccagattaaacatacgctacgtaagagtggaggactgtcagatacttgactatatgtaaggtagacactgatagcatgggtgcctgaatcagactaccagcgttcacatctgtatcagttcattcccgcatccctagaaagaacaacttgagactggataatttatgaagaaaagagatttaattgactcagttccacaggctgtacaggacgcatggctaggaggcttcagaagacttacaatcatggcagaaggtgaaggggaagcaagcatatggtggcaggagagagagagtgaagggggaggtgctacacacttcgaaaccatcagatctcatgagaactcactcattatcacgagaacagtaaggggaaagtccgcccccatgatccaatcacctcccaccaggcccctccctcaacactgggaattacaattcaacatgagatttgggtggggacacagagccaaaccatatcagcatccaagctcaacagctcacttactaggtgatcttgtatgagtcagtacacctccatgtctgttttctcatttataaattagatctgatcattgaaattaaagagttgtcataaggatgagtgcaatacagaaatattggtaaattctggtaaatacagaaatttaagctgttatcaaatcattgtcatcatcatagtggctaaaagttagtgaagcaatgatttagatcaagtatggcaggcacatggcatacgtggcacaatttcttcctcctgcatccatggtggacatggctagttgattgcagaactttgcctttaaactcagatgcagcctcagaattggtcacacagagttccagttatccccaaacaaagttgacggacagatgggtgaaagattttttgctaccctctagaacctcatcagaaaccagataaaaccagccgctcccagagaaacagtcacttcttgttggatagtggaaaagagcggctccctaaattacagtcatccttccaaagaccgacataattttgccatatctgcatgtattgtgtgctattatttatgcaatgtttatttgaatatatttaaaagagaaacttatacctgcatcccaaatgaaaaatgagttgacacaagccctaaacagaagataatgtgaaaagaaagaaaagaaaggaggaatggtactgttgtaatccggctagaaaacactgtagtagtaggttctgaatgtctgctttccattgttaaaaagggaaactgacaagttttagaaaggtgataaagatgtgctaacaacaaaccgagacttcctctttgactcaaccacttcctataagattcaatgtcatttaaattgtgccaaggtacctgtagtaggcagctcctaagatggccccaaggatacccactccagtatccccactcccacccaaatccatccggaatgtgagccagatttagtcactcacttctaataaacagaaaaaatacagaagtgatggtattccacattcaaggtttggttctaaaaagactgcagcgtattaggtgcatcttaggtgctgtctctcccatattctctcttagatccttggcttttggggaatccaactgtcatgttgtgagcttccctatggttaggacctgtaagaggcttccagctaacagccagcaaggaaggaactggggcccttggtgcaacagcccatgcaaaactgaggccagctaacaactacgtaagtgaatttggaagcaaatcctccccagtagaactttcagatgagaccaaagatctggccgtcaacatgaatgcagaatgaactgataaccttcataacattttctaattaacacatattcattgagaaagcaaagattcaagagatgcactgaaccagagcacgctgcttgctcacccatacaggcaaacaataagtggtaagtatcagaatgacttcctggatgagaattttcatgtacacatacacacataattacagtcagcacaactgcattcaatgtcagccatttctatcagctctttctcgttctttgatcttaattacatgaacaagtagcagaccatgagccttagaggcctgtggacctgagttccagtgccccctctgcccctaatgaactgtgtggccttgaaatagaaatggaatcttatccgttcatctgcagaatctggatactaagttccacttcacatgtcaatgaaaggaatagatgcatttgtatttgaatgtgattagcatggtttatggttgcctaaataaaatataagcttcctagtgtaatattctccatggactactgctctctgctacgatctataataacccaggctggagaagtccagtaggggtaagtttcacactttgggtcaggggagtcagcactgcatagaaatctaaagcaaaggtggctgaacgagaaaagctaagttccaacacttactaatggcgtggctgtgagcatggtaccgaccctcatctgtaaaacgggcataaccagtgcctacctatgttctgatggctgaatgagataatatagttaaggactcagagtagtgccaggcacacaataaaacaaacaaatgttacatattttgtcaaaattatcattaatttttttgagatgtattcttgctttgtcacccaggctggagtgcctcagctcatgcctccgcactccagcctgggcgacagaacgcctcccaggttcaagcgattctcctgcctcagcctctcgagtagctgggacgacaggaaaaattatcatttattgttattatcactatcataatttaattcataagtggttatatagagacctttatgataaatccagctcactgaaatgttttgtttggccacacagggtgttactgaaaaaaacacaaaactgaattagttgttaatatttattaaatattgcactaaaaaaaaggaaatttccggttgcttttaatacctgaaagaatggataaccctgggcctgattctcttacagtcacaggcagtggagccaagaagcaacagtccactgcctctgctcttctgtccaccaaagtcctcaccattccctatcgccctgcacctgtcctagagtaccaacttacttctcctggcctcaagggaattgggactttggactcttgttttaattccttaaagtcctgccttaaatttcaaattcttggatgatttttttaaatagcaggtactctaagtagcaatcgcaagaacagatcttgaataagattaagtctccctcaggaaatcctcagcaacactaagtgtcagataatggctgaggataaagataggatcattatcaaaaggaggataaagatccagctctctacaataaccctccacacgtgacccaaaaatgagcttccagagcttaaacgtcaaagcgttaaagttatttttgccatccccttctgtgatggttaatttaatgtatcaacttgatgtggccacagagtacccagatagtcagtcagacattcttctggggtgtctttgaggatatttctggttgagattaacatttgcactggtggctgatccacccccatgtatggtgagctcctctgcctggcttcttgagctgggaaacctgtcttttcctgcctttgagttcagatgaaaacattggcccttcccagatcttgagactgctggttttcagactggaacaacactctggccctcctgggacccagcttgccaccgcaggccttgggacttctcagccatcatacttgtatgagccaattccttataatgaaactgtatgcgtgtgtctcatatacatcccattggttgtttctctggagaaccctgactaaaaaagctgttatcaaattgatagtgcagagcttacaactcattgcagatcagaatcaaaagtgttaaagtgatttttgcccacctaccccccacctccatgatggttaattttaggtgtcaacttgactgggttatggggtgcccagatatttggtcattcttctggggtgtctgtgagggcggttctgaatgagattaacaccacatattgccccacatatttaagttgaggagcctcaactctctgcagacttatcactgccacaggctgcctggagcatttttagaccctggaggttccacagctctggattctcaatgagcccatggattcccccaccttgagagagggggcaaggaccaccccaggggatgctgggaagaactgcagagcatcctccaataagcctttgcagctctcttccctcttccccatctcctgagcccagctttctgcatcctcattcttttggaggaaagacaaaaacaagatcgccttattcctactcaaattagcaacttcatggcttaaccttcctccaaaactaaactgagagtggcaatataggggatttggattttcttcttcacatattcatctcctaaatgtttctcggtgaacgtgtgttactttaatcagcaaagatgatacaaattattgattcattctgcattcactctatgagaggcagagttagctcagcatttgaggactggacgcattggagcagaccgcttgggtgcaaatctcgactcaactctgtgacctcaggcaagggtcttaaatgcttttgtaaaataagtatgaaaattgtagttacctcacagggtggcagagattaaaagttaattgaagcaaaggaattggcatgtgcctgacaaatagtaaatgctcagtaagtacttgctacctatattatcatcattttatagtatgtatatatagtatgatataaaatataaacatacatgatatagtatctgatatggtttggctctgtgtccccacccaaatctcatctcgaactgtaatccccgtgtcgagggagggacctggtgggaagtgattggatcatgggagtgatttcccccatgctgttctcatgatagtgagcgagttctcacgagatctgatggtttaaaactgacagtttcccctgcattgtctctctctccagccaccatgtaagatgtgcctgccttcctctttgccttccaccatgattgtaagtttcctgaggcctctccagctatgcggaactgtgagtcaattaaacctcttttgtttataaattatccagcctcaggtggtacctttatagaagtgtgagaatggactaatacagcatatattaagttcctgctacatgacaggcattagaaacgtagtgatacaactaatcacctaaccccatgggtcttaacctatctagcaggagtgggacattatataaatacacacctctttctgttccaggatccaatccaaactgctttgcactttgtcatcatatctagactagagggttttctttttgaaagctcaaagctgatccttttcctgctttgagctcccaatacttttccatgacactctcaataaaatccaaactccttgctttggtctcaatctcaaagctccccatattttcacccactgacccctcttcctttcccccaccaggctcccctcactcaatgaccaccaggcacactggccgttcatcaactctttgaatcccaagcttcctccagccttcacattttctgtgcctcctggctggaaatctgtttcctcagaggtcctcataatgtttcctcttcatgtttaggtgtaagtgcgaatatcacctcctcaaggaggccttccctggtcatcccagccaaacaagtctcagcccaccatagtcaccgtctaatacacagtggtttttagaagaccactaattgctaaactaatcctatttatatgtttataatttacagtctaaccctcagtactggagtatagggaccttttctatcttgttcactactttttttgtctttttgagacaggttctcactctgtcacccaggttgcaatggtgatcacagctcactgtaacctcaaactcctgggcttcagtgatcttcctgcctcaacctcccaagaagttgggactacagacacatgccaccatgtccagctaacttcttcttcttttttttttttttaatagagacagagtctcactatgttgcccaggctggtctggaattcctggtctcaagtgatcctcccgccttggcctccaaagtgctgggactacaggcacaagacaccatgcccagctcaccattttattgtaggtgcctaggagagcatgctgcacatagtagatgctcaataaatatttgttaaaataaatactattggaaggaatgaatggatgaaggacaggcatatattttcaaatgttcacagatgtgtcgcaagaacctagtgcagtgcctggcacatagtaggtgctcaatgagtacttgtcaaaatacagactgagggaatgaatggataaagggcagacatgcactttcaaatgttcattgatgtgtccctagaacctagctatggcacctggagcatagtaggtgctcactaaatatttggtaaaataaaaatgggttagaagagtgaatggatgaagggaggacaccatttgtttttttagacagggtctcactctatcacccagactgaagtgcagtagcacgatctcagctcactacaacctttgcctccagggctcaaacaatcctctcacctcatcctcccaagtagctaggaccacaggcaccaacatgccaggctaattgtttgatttttggaaagacagggtttcactatgttacccaggctggtctcaaggagcctgagcttaagagatcttcctgcctcagcctcccaaagtgctgggattacaggcatcagccacacttgttcactgatacgtcccaagaacctagcccagtgcctggcacgtagaggctgctccataaatattaatatttgtcagatgaatggcatttgagtgagcaccatccattgttaaagaaagaggtgaccacatagagtgagtcggctggaggccactcttctgcccaagggcctctctcaagaagtcaccagaaaggaaggctgggagcccttcctggcagctgccagaacatctgtctagagaggccccgggctcacctgggctgcgtggaggcctgggctgggctcttttgagcgactctcactactggctcaggaagttccacccagtgccgccccagcatggaggctcctctgtggcctcaatgcaaactcgcctcagaaaaggcagctgattaacacgcgtggagggtctattgtctgaatcccgtcaccagcggagaaacagctgtttatagtttgtttattcctctccctttggagcccacgggaggaaacacaagcgcttgttctcaggggcaccattcagcagctgaagtgagtgaagaaaacggtgtttatttttaatgggataaagagggggaactcttacaaagtttggacactagcagggagaccgctcttcaggaggcaccaggccttgtggtgatgtgttgcaccctgcctctcgagggatgctcaagagtctattccaactcccagctggaaactcaggctcgggccacggtggtcggtcaaacagtagacttgggtgagcacctatagatatgagagatctagaaaagctcgtcaggcttgaaaatgagagagcaagatttctttggagagcaaccacctgctatttaatataggtgacatcctataaagggctgccaagcccagttgtgcaggctgggcactgcacaaaggtgtccagctgagggagaaatccagcctctgtgagctgctcatcaagccatgctccacagtttcaaaaataaatacatacataaataaagatgactaagtgagacaacagcagtctcacagatatatagatgtatttatgtacttcatctttaaatgctcacttattgactcttcacaataacctttcagattagggaccactgtcatcctcactttacagatggcacactgaggcagagagagggaacctgactgctccaagctcatccaattaggaaggagtgaatccaggattcaaacccaggctcttggtttccatcaacaggtgatgctgcctcttctaggaaaaaaaaatggctcaacaagccccagagtgtcatattcagaaaacacagtgcccctcccagtcttgggagtgagacctgctttcagaaacacccatgtcttccctcgattctgcaggtgatcaggctggaaggaggtaggcgaagaccccatcgtctgcattacaaggaactccttctaaagactcaaaagatttgctctgaactggtgaaagtctggggactcccactcagcctggagactcaaccaaccctcagcggggaacagcccaacccaaccagagctgaggccacccgctgctcccttctcagggcccagggtcagccaaggccattttcaagtgcgggggactgcagccaaactcgctgaaccagacccaggggagcccaagagggacctctggactcaagggaagaggacgctctcatccctgtctactctcccacccaccccctcctcccctccatccctccctccttcggagagcctccacattcgaatctccgaaaatggttttcacaactcagttagcagcaatcaattattcacgacctcgcttccccaccaactcatagactgtcactgttagcaagataatttctggactctgcccaacagccctgctctaaaccaagcggcctgctatttatttcctctcttccctaagaccctcccaatgcccaccaaccactatcactctcaacacaggacagagagacagatgggaagtcccctgggtgcctgtagcctgggagggacctgacagccaggggctgctcccagcccacgtgatacatttcaggcttggggcagaatgtctgaccttagtttaatccaactggaaaacaggactcaagcattctagaccctgtgccaggctctgggacaaatcccacattattttataaaacgctttaagctccgaaaacattgtgtcctgcacaaagcatgacttgggagggtctcccagacatgccgtcctgctgctgagttcatgggtcaaagacatttggaacttggcaggggctcatattttaagactaccactagcatttccatcctagaagcttgaagctgtctttaggaacatattcctacatcccagggagaaggagagaggtgcttatgggatgctcttggaaaaagagtttcagcctatgtcgtaagacccatggagggtggttggatagcagctctgctgtgtgaacaagcgaccttccacgaaagccacttttcaccctctaagcctcaatgtccacatttgtaaaatgggagaatatgagtactacttctggggctgcagtaagagttttaaaaaatgaggcatttaaaaaacacccagtaccttgcttggcacattgtggacattgtggcctctgtgcttcattgtaagaccctgtcgcttgtgacatgcatcattgattgaataacaatttggggcaaaagggtgtgtgctgaaacattaaggaaacatacacatcaattgtaaaattcatcccagatttcagaaaggctatttactaaatattaaaaatgtgtatctttggccagatgtggtggctcacacctgtaatcccaccactctgggaggccaaggcgggtggatcacttgaggtcaggagttcaagaccagcctggccaacatagtgaaaccccatctctactaaaaatacaaaaattagccaggcgtgatggcacatgcctaaaatcccagctacttgggaggctgaggcagaattgcttgaacccgggaggcggaggttgcagtgagccgagattgcgccactgcactccagcctgggcgcagacagagcaagactctgtctcaaaaataaaataaaataaaatggctgtgagcctgggcgacacagtaaaaaatgtgcatcttaaaatgaagcatattatcattattatcattattacaattgctgtattcattttaggtgggaaaatgcatacagagaagctatgtgactgaccgcaggccacacagccagcaacacaatctagtccccacacagctccagaggaaggagggagaggaagaggcagagttgaccaggcaaatctccctcatccaattcctcctcctcctacaagaatcaacagtaataataataatggaagatgagggtgaggggaggtggaggggggaggaggaagaggggggaggaggaagagggggaaggggaggagggtggaggaggaggagggcagaggaagaggaagaggaggaggaagcagcagcagcagcatgttatggtgcttaatacaggcccagacactgtgctaaatgaggtgcatgtattaactcatttatttctcctgacaaccctttgaagtgggttcatcatcatccccattttacagatgaaggagctgaggcacaaagacttcagtcacacagctgctgggtggcagagccaggctgcgaactccggcaccttggcgccaagtccccgtgcttctctactgcattgcacttcattccaccaactgagacaaagagggacgttttggtggagaaggaagtggcatataagtgtcatgccatgcctggtctcacccacacgcccaaggaagttcctctgaacccacagagcatgccctgggctccctctgatgaaagcaagttcatgcctctcttccactctctcctgctgccccaggccagctgagcaggccaaaggagggctggggccaaatctgcagccccatcctggggaaaggctctgacgacagtagccagcttctcactgctgtctgcaggatctcagcaattccacgggcatggagaacagcagcccctggagagggtaggagaagattgggtgtctgccaggcctgcagctgtggacacttcccctatgggctgcggggacggggcaggcccagcacctggaagagggcgcctcccctgtctggctggtcttcagtcccatcaacgggacttagcatcaagtgacgtggtggttatgcacacgggcttgtggggagctgtgcaaccttgcgagagttacttcccctctctgtgcctcacttcctctgtccataaaacagtgactctgacaatgctgacaacactaggtgttggaagcattaaatataaaacgcctaacatgtagtatgtgcttaataaatggtagctgctaattactattatttatcatcatcaacaggactatgcatcaactactaagaacacaggtggaccttaaggtgccatcagtatgggtgaggagctgacaagaacccatggaacaaggcatgattccttgttctagaatatctttggcctttggatcttaaaatgtcatcttaaagtggggttccatagctctcacttttaagacatctcatctgatctttcaggcaatttctgaaggaaacaaaaatatttactgagcacctattgtgtgccattcactgtttccaccactgggaataacctgatggagttaatgaatccaagaccagctatgatggtgatggcagttactaataaaaggtgagaaggaccgggagtggtggctcacacctgtaatccagcactttgggaggtggaggcaggcagatcacttgaggtcaggagttcaagaccagcctggccaacatggtgaaaccccacctctactaaaaatacaaaaattagccaggcatggtggcaggcgcctgtaatcccagctactcaggaggctgaggcaggagaatcgcttgaacccaggaggcagaggttgcagtgagctgagattgcgccactgcactccaatctgggcaacagagcgagactccgtctcaaaacaaacaaacaaacaaacaaacaaaaaaaaaaaggtgagaaggattctagagtttattgttaggtagaagtgggaggtactgggaggaaaggactcttttctgcagacaatcacaccaaaacagccacgtacacatggaagtgggaaaggacacgtgggtcacacacacggctggaagaagagacatgtgcaatcagggcacaggtaaccacaagagacctaaaagttcagagcacaagggacccagaatccctcagaccattttaaagacggggaaacagagaacctgaaaggcaggcagcccaaagccacaccaagcaagacacagaacaggttctggaatccaggtatcctgactcctgaaagtcgagatcactttgtcttgcgtcgtaaacagactaagacattccagcacagcacagcccgccatcacagacagacactgctgccaggtcaggcagcccccatctgccatctctctagatcagtgttaccaagctgaggggagtgtaagacaccaccaccctcaaaatcaaacaccttaggacaggaccaaagacaggtaagttttgacatggagatgagggagagaagttccgagttggggacatcatcattctgcaggggcaggtggggaatcgaaaaagccgttgcatgcaaaggacaaatgttctttcattggaggtggagtgataataactgcagagggactctgggaaggttgttggacagagtgatttttgtcttcaaagaacgtgatcaactttttgcaagtgttcaagttccacctccaaatcttgcaatttctaaaccagtcaacttttctaggtttttaataaaacagagatgatgaacccattagcagggctgttgggaacctcaccccagaaaacagttgatggtggcctggaagcccctgcaggctcttgttcctgtccttcttcccaaatgactttcatgtccttgtcataatgaccacattgtttacctcctctccccgcaatccatgccggactatcttctctttgtttcatcttaaatgtcaccttgttggaaaagccttcccagatgaccctccccttctccctgactcactgtcccctccatcggaacctgagctgcaggaagtcagggaacgcgttctgtccactgctccaaccccagctcccgtgcagtgactggcacctagtaggctcttggtaaaatctgttgagtgaatgaataagtgtctgcaaacatcctgggtacatctgtaaagcatgcactcatagaaaacttctactatgtgacacacagtagattatcaatggctgttgctgagaggacatcaaagtcaattccaaaccaacaaggtcggcttcccatttccgctgtggagtagccttgagcttagtgagatagaagactcttgcccatcaccccagggacctgctccccagagctcaaggcactcagtaatgaggaaaaccctggctttacaagacacagtaaggcatgaaaactggggagaaagttcactgggaacctgcaggacactacaggtattctacaaaatgataagctactctgccattcttaactattcttaaaaatgagaggaaattgatcagcagaaaaaaggtacatgaagtgtgctgtgttttgatgtgggcaggctaagtgataacttcccctaacccgcccatcctaataacatgaaaccagtggtgcctcctgctactgacaggttcccttactcaattgctataagagaagcattgagcaagcattgagaattaaggaacctacagcctattcatagattctaaccctaagaggaacgaaattagcactttgtatggttgggtcattaaaggatctcatgaattaatactatcgtgtttgcattctgttttgtgaatttctgcctttatttttcttaatgtccctttcctactttcttttgtttgattctcagtttttttctttttttttttttttttgttagtaacagggtctcaggcctggcaccatggctcacacctataatcccaaaactttgagaggccaaggcaggagggtggcttcagaccaaggagttcgagaccatcccagcctcaattatttttttaatggacttttattttaattattttactctttcatatttaatgtcaaaacctaaagtgcttttaaaatagactaccagttttcctctgggcacagttttaaccttatctcaagttttgatatgaagtattttcattttcgctaatcaatatataatctgaaatgtcaaatttaatctattcattgatctaagaattacttagaagagtttcgattgtttaaatttctatgcgattgtcttttagaggctaattttcaatatatcttattgttttatgaaggaagcctggaagttttctacttttgaaatctattaagattctttttagaccaagttaattatcagttgtaattagcacgttagaacatctagaaagtagtctttaaaaagagaagttcttcccctagaatacacacacacacacatacacacacacacctttgtaaagagtttcaatgaatacttacaattctagtcttaccttaacaaaagtaaatattccaacagaaaaagacaacctattaagctaaagggaaaggaggcaaactaccagaatttaagggttaagtttctcacatctgggaattccactctggaatcataaccacaatagcattgcagctttgcagccctattttaaagacgaaaactgaggcttccagatcctgagtcacatagaaaggattttagctgagcccaagggtttcaagtccacaaatcctttctgcactaaattcaaatttcattccaaaagtaatactaaaacagcagctgaccttcttctcttgtgccattccttaagtttgttcatcgcaccaggcagaatcagaagacaggctcctacaacagctagggctttactcctggtaaagtgggttggcttaggagaagaacggacaggactctttgacaagccccagaaagaatattaagtcatttttcagccagcaccaagcaaacctgaaagatgggtggatcctagggtatcctaattttactcttccaaccctgtcagtgctagtgtccaaaaagtggagcagcaaatgggaagtgactggcattcagaaactgacacaggatcctgcatttctaaacaatgctgacaacgcacactgaggcagcacctccggggaagtctccgtgctccgatgctgtggccatgtacagcatatgcagtccccaaagggatatttcagcacagagtttcaatgtaaaatgacacacgctactgcaggctagagatcttattggggacacagggctatattcatctgcttcccagcaagaaaaccagaaagccagagataaacagaagtcaatcaaagcagaaagtgacatctagaaaaaaaacacctaattctgccaaacctgttttgctgaataaagataagagcgctgtggacaatatggctttggtataagaaattaaatgatggcaccattcccaaaagcaactaaagcagttgacatcgggcttgttcccaacagcctagaagggactaagaatggaagaacaatggacaattaagaaactgtttctacggactctgaattttgcaagactaattatgaaaataagccttgttacagagtttcagcatttgaaagtattactgtgctttacttcctactctgaaaggtaagacttccaaattaaaatataattgtcaaatcaattggtaaaaaaaaagtagttaaattaattccgctcctaggtatatactcaacagaaatgtttgcatatgtttgccgaaagagatgtccaagaatgttcacagcagcactatttataatggccccaaactgggaacttcccaaatgcccataaacagaatggatatgtaaattgtggtatattccacaatgaaataatgcaaatgaacaattacaactctgtgaaccaatatagacatagggttagcaaactttttggtaacaggccagatagtaaatgttttaggcttagggcccatacagtctttgttgcaactactcaattgtgctgtcatagcacaaaagcggccatagctgatatataaatgaaatggacatggctgtgttccaataaagctttatttatgatcgcaattttttttttttttttgagatacagtgttactctgtcatccaggctgaagtacagtggcacaatcttggctcagtgcaatctctgcctcccgggttcaagtgattctcctgcctcagccacctgagtagctgggattacaggcatcaaccaccacacccagctatttttttgtaccttttagtagagatggggtttcaaccatgttggtcaggctggtagcaaacttctggccccaagtgacccacccacctcggccccacaaagtgctgggattacaggcatgagccaccatgcccagtcaatttgtggacacaaatttgaatttcatataattttcacgcgtcacaaaatatcattctttcctcccccccccgcccccccccgcaactatttaaaaacataaaatccatccttagctcacaggccatatgaaaacaggcaaaggaccagatttggcttgtaagctggggttcgccaaccctggacagagataaaactcccagacgcaatgttaaccaaaacaaaccaggcacaaaagagtacagactgtatgattccatttctaaaaagaggcaaaagtacctggtggggttagaagtcacgatagagaccctatccttgcaggcatggggtcagagtggacgtggccgggatcccgggggctggtgggctctgaattcgggtgctggttagttgggcgtgatccctttctggagctgtttattcatgatttctgcattctttctcatgcatgttctacttcaagagaagtttagcaagtttttataataaagtagcttacaattcaatcagcttcaaaaacagaagtataaagagaacgagagcaatcaaattaaattagttatgacttcttcatgatggccaggtacctgccaatgctagagtacttaagaatatttaataataatggctgggcacagcagctcacacctgtaatcccagcactctgggaggcctaggtgggcgaatcacttgaggtcagaagtccgagaccagcctaggcaacagtgagactccatctctaaataaataaataaataaataaataaataaataaataaataaaaggtagatttaaattgttttcctctattattgtgtttacttccagggtggagtttgtttcatggtttaagggatggtgctaccatcagaatccggccaggctattttctgcggcgtctgcgcataaagatgatgttcacccaattaccagcgactcctcgcatggaaatctaccatcaatactattaacataaacagcatctggcaaaatacatggccttcaacctacagcaaaacctgcgctggactctcacaaaggaaaaaggccaggtctggcttccatttgatttccagagaatacgcaattaattattttttctcaccgtcagcagctgagtctcagtgaaatccgtgcttgtaattatcgctgtaattattattttaatacaaatcagcaacttatcaaaatattacgtgtcaggtgctacctctctgctgcaagactatggatggaaggtggaggccgtcaccccagcttcactctgtgcacacagaggatgggaatcagggtgagggtacttctaccagagccagactttcagcttcctagatgtccacgtccacagtcagtttcacactcgaccttttttttacaggcaataagtcactctgtacattctatgtggtggtttgatcttgggcaattcagttcactcactgctaggtctcagtggtaccatctttgcagcaggcaaacagtacaaaccttttttttttttttttttttttggagacaggatcttgctcggtcacccaggctggagtgcagtggtgcgatcacggctcacagcagcctcaacctcccagggtcaagtgatcctcccacctcagcctcccaagtagctggaactacaggcatgctaccatgcccagctgattgattgttttatgtttttgtaaagacgaggtcccactatgttgcccaggctggtcttgaactcctgggctccagcgatcttcccacctaggcctcccaaagcgctgggattacaggcatgtgccaccacgcccggcaacagtaccaactttctggcagtgtccttctgaagaaaacctaatgggagttgttacatctttctgtgcggcacatgcatggcatttgacacacaggctcctgagtcacgctggctgagttgaaattccaagtcttctctgtgactgcaggtgatttcttaccctctctatgcctcaatttcctcatctgtagatgggaatactatcagcagccacatcataaggctgatataatgattaaaatgataatctaggagacgctgctcagtacagcacagtgcctgccacgtagtgacatctaatagataatagcaattattattattatcattctgaaagttgcaaactcaaaccccaacagccatcttgtgggtaacacagacaagtaaagtgacctggtgggcccgtgtacacgaggcagccacatcccccctcactcaaatggttacctctgggaatgaagaccagaatttcgaatttcttaataggcactctaaatttgatttggattggaaatcattgattttggctactaattcaagttttgatttttaaaatttaccttttctttaagaaaggaggaagaggaccctatgctgtcattattccatctggagcccacacctgactcacaaagctctaggtttccttctggcttacgtatttcccatcgctgctttctagcacccaccttcattggagggctgtatctgcctgctcactccaataaacagtcagtttcctccaaatgttgctgttgtgcgttttttgtttgctttaattctaaaagaaagccaaacagcagtcagcctccaggccaaagaagaatgaataacctaacttctacccatttctaaaccacccagtctttcactgaacatccttccttaggagacgtttagcttaacatctctccctgctttctgtctttaactcaccttctaaacaagagaaaatcagacgtcacaatttgaaaactatccctcaatagggttacaagaaaaagcaggcaataagagcattttacatccacaacagaatcatctgcaatacttgatgacaagcaaacggggttctcagtgtctttcataacagctgccccttttgagctaggataaaagaaagtgcaaaagagagacaatgaataggcttttatttcaaagagaacatctgcaaagcatagtcctccattaaaaaataaacagaaaacagccactagtctggggaaaaaaataagatttcccattacatctctaattaataaagccccatttcaaaaggaaaaaagaagaagaaaaaaaagaataactttttcacatccccaaagaaaggatgcttaatgaggtaactgttgtattacttgatccatctagtctggttttaatactatccttaaataatgtatacattagctttccattaccaaaaacatttgtttattttatgaacgtgagtctggttgagagctgagactctgcaaaattatcatgccgtccttgggctcccggcttttattgcttctcccctcgctcattatgaaatgattagttgtctccgatgcccttttgaattgctgctaacgttgtactgcggttctgttaccctggttctgaataggagagtcttggttcagggttaagttaatgtagtcattactggcccatttggggacccattcatcatgctaatttcatgtccaacacttgggggaatagagtacaaatactcaacgtgaagcaaatgcacagtgaatccaaaagacgcacatgaaatgtccagaactcagtcacagaagacaggcatggggagctctggggccattactttccataactgtgggagcaatgcagacatcagagagggcctccaatggggaattcctttccaagggacccagagcacagttcctcctaacatctaactttaatcctttccacttgaacttcagaacaaaacagcacagctgtttaccagaggagcaaagactcttcaaactggttaagttgacattgaccaaaccttggccatctcagcacttccttgatcgtcattaaccaaccaagctgcaatcaggatttgaaatccagttagagtttgcttatgtgttttcattttgttaacccacttcttcttacttaaatgccactttacctgcatgttaaacgagaagagtgttgaagctgccgttttgattggctggttatatttctgtattttccataatatacatttaaagaaatatacagcgattaataatttctttaaatattcacccaagaagaagagagtgcatctgggatgttgtcagtgctatgattcctggtctaggatactcggatgtgttcagtttgtgagaattcatcaagttgtatatttagagtaatgtttgtatcatatggttttgttgggaaaaaagcaactaaaagaacgcaggcaatatttaagaagtgagccagacgtggtggctcacgcctgtaatcccagcagtttgggaggctgaggtgggaggatcacttgatcccaggagttccagaccagcctgggcaacatagcaaaaccccacctcttcaaaaaatacaaaaattagccgggcatggtggcacgcacctgtagtcccacctactcagggggctgaggtgggaggactgcttgagcctgcgaggtcaaggttgcagtgagctgagatcaaaccactgcattctagccggggtgacgtaaggagtccctgtctcaataaattaacaaataaatttaagaagtgaataaatgttgtacagatacgaatagtaactttttataaagagtttttacagaatatctgcccttgtagcacctccaaccactggtgcatcacgattggtgtctataccatattttggattcctggggctcgtttaggactactatggcaaaaggcatgatccaaaataaatccttacccctgaataagtaaaataaatccacccatccaaaacaaatgcttatccacagctctttcttttcgttcagctccctaatggtttccttcgctgcatttgtaacaatctgattttttgcaatgttcttgtttgtttttattgggaggtcatcctgcccccaaaccataaagagcatgagggcagggtcacatctgtctttccccctgctgtgcataaggcctggcacacagcagaccccaaccagtatctgatgaatgaatggatgagtaggtgggaaatttccagtggatttcactcattcattctctccctgtcccccacgggttacaagacgctgtgaggaaggaacgcagacaaccccgtctgaacactcccacattgtgctgcttgaagacatgagccccgtcttccattcacatggggctttctgagcttcaaagcactttctcatctgtttatcaaatttaatcctcacaacccagggagggaggcaggcttattagcatcatctgatgaagtgccaaaaagacacagagatgaaagtcacggtccgtccctgacagcgctgggaccaagccaaggtgctcaggaatgttctacttttccacctcccccttgtctctaaagactcccaacttcccaatgcgtgttattgggggacaaggtcacgggaaacacagagtgaggggcagatgactcaaaggaggctgtcactcacactccctgcagaggggaaacaggtttatcaaattgcggaatgcatgattctatttctgtcggggacatttgccttcaggatggcctcatgcttataagaatttgcatattctgggtctccaccaccagctaggcggggagggagactccatcatgccagggcaaggcacaggcagtgagaggcaaataagtgcagtgaataagccacatgggaatagggtaaccacagatgctcatttttatgtcttcatagtgaacacggaggtcttccaaatgggctgcaaactcaacagccaagaggggccagccaggtgccacaggtgacaggagagatcttagggggactcttagggacccagtgggtctgcagtatcaccattcctcagcttggctgtttaacaccaagcaagcaccgtggaccctgtattgccggatcttatgacttttaaaagaattccaaaaatctacgctgtctcacggcatatcctaatctttaaattccagggcctatttattctaacacaccgtgtggacaaaatcaaacccacccacgggccatggatttgaaagtcctcctggctctagcaaacatctcctacgatgtggctgcatcaggtggcagagcagagcactgaccatgacccagagctgtgcctcaccatcaagccctgccaggtaggtgccatcatggcccctgtgcttcagacaaggagactgagctccagagaggcaaagtgccataccaccgatgatgtcagaccactgtcttcttcctcaacatcacacgacctgcctcccaggccccacagcatctgcccatctgctcccctggatcatttccagggttgtttcatgagctacaagaagaagagcttgggccccatgagcagagcagcccaggcctcatggacagttctgggatggcagagacctcagggctcccagggctctgaatcatactacttactccttgccctgaccttcccagaggacacctcccttgtgtgttcaagaggtcaccatgggaaagggtataggcaatgaaccaggctaggatgtgagagtgatctccctagagatcggccacttatcagcacgggctctaactcttgcctgctagactggtcctcctggagggcaggaggcacattggtcctgttcaccaaggtggttccagtgctggacacagggactggtaccttctaactgcaggagtggaggatgggtagataggtggatgaatggatcgatgggtaaatggatggacagatggatggatgaatggacagaggatggatgaatggacggatagatggatggatggatgcttagacaaatagatgaatggactgatggatggatggatggatggatgggtggacaaatgcatgcataaatagatggaggcagggggagaatgaggggctagagtcaacggacttactgactctgaactgggtagactgagaacacagcctttggagacaccacccaacttcaatttctagtttggacacttcacatctgcttaattttcatccaacttattgccttagttttcattatttcaatcagtaaaacagaaatgaaaataatagctcttaacttgccagatgttataagaattcaataaaagcatgtctttttagtccttccacagtgtttggtgcattcgataaatgcacctcatcatcaccatagttgcaatgtttgtgcctcctgggtagggaacatttgcatcaacctctctgccccacaaactcatcttaaactgaaaccacacatcttgtggccaaaaattatggcaaagcgtgccctgggaggagaaacaaatgcctcttaccacattacctcattagcatccactgacacattagcctggattagatgtccagataagcagtagtcacctggctgggacaaactaggcctgggacaggacaaatccattcattgcccctaggtggccctgaaagatgagacaccctcgtccacacacacaaagcttgagaatgggtcccaccccttcctcatctggcagggtgtctgggtttgcagttcctgacactaataatgccagtgtccaggttcagggctaaggtgacaccccaccccacacccatcttctttgtgatgcctctggcttccaatcgggaagggggcaaccgaacccagagagcacatgggcaccatctgatgagcatctgcgggcaaacgggtagtttctgttgcaggcggaaggaagtgtccgcaagatgatccgcactgcatgtttattgaggtaactctccagtgtgctgcagacccaggctctcaggtacaagtggcgggctcctcagtgggccaaccacagagcggtctgaaggaatggagcagcaggaagtctgttgtggttgaaagaaaggccattgtccccggccaaagaaccctgaacaatatcctcttgccccctcctccgcttctcccttggttagagagagctgaattcaagactcctctctctagccaatttcaacttccattcttgactgttgaaaatataatagtacacagcttgaaggattaaatgagttcatgcacaaagagggtttagaacagtgcctggcaaacagaatagagaacgcagaaataaacccacactttaatatcaactcatttttgacaaaggctggggaaaggaaagtcttcgataagtagtgctggaaaaacgggatagccattacctatggataaacttaagaatgaaactaggccccatcactcaccatacacaaaaaccaaatcaaaatagattaaagacttaaatctaagacccgagactatgagacgactagagaaaaaaacattggggagacacttcaggacgctgagcaagaattttttttgggtaagaccacaaaagcacaggcaacaaaagcaaaaatagacaaacgggatcacatcaagctacaaagcttctgcacggcaaacaatcaacaaattaaataatctacaaaatggaagaaaatatttgcaaactacccatctgacaagggattaataaccaaaatatataaagaactcaaacaactcaacagcaaaaaaacaagtagtccaattttttaaacaggcaaaagagctgaacagatatttctcaaaagaagacatacgaatggccaatggatatataaaaaaatgcacagcatcactaatcaccagggaactgtgagtcaaaagcacagtgagatatcatctcaccccacctgaaagggcttttatcaagaagacaaaaaataacagacgctggtgaggatgtgagaaaatggaacactcatacactgttggtgggaatgtaaattagtacagccactatggagaagagtatgaaggttcttcacaagctaaaaacagaactaccatatgatctggcaatcccactactgtgtctacacaggaaaggattaattatccaaaggaaaggaaatcaataaatccaagagctatctgcactcccatgcttactgcaacattcttcacaatagccaagatatgaaatcaagttaagtgcccatcggtggatgaatggataaagaaaatgtggtaaacacacacagtggaatattagccagctgttaaaaagtgaaatcctgtcatttgcagcaacatgaataaaccggaggccatcatactaactgaaataagccaggcacttagagacaaatatcacatgttctcactcctatgtaggagctaaaaaaagtagatgacaagaagatagagagtagataggtgattaggggagtagggaggaagatgttgattggaaggataaaaatccagttagatagaaggaataagctctagtgtttggtagtccagtagggtgattatcattaacaataatctattgtatatttcaaaatagctagaagacccgggcacagtggctcacatctataatcccagcactttgggaggccaaggcaggcagatcacctgaggccaggagtttaagaccagcctggccaacacggcaaaacctcatctctactaaaaatacaaacagaattagccaggtgtggtggcgggtgcctgtaatcccagctaatcaggaggctgaggcaggagaattgcttgaacctgagaggcggaggtagcagtgagtcaagattgtgccactgcactccaggccgggcaacagagcaaaactgtctcaaaaaaaaaaaaaaaaaaaggagctagaagagaagaatttcagtgtctctgacaaaaaagtaaagataaatgttggcggtaatgaatatcccaattactttaagttaatcattacacattatatgaacctatcaaaatatcacatgtaccccaaaatatgtcaaactattatatatccatttttaaaaccacctaacacatcataactgccatgcagtcattattattattattatcattattactacccttgtatttgcatcatgagttaggggtctgattcaatataaattgcatgtctgcttcttttctagggttggtaactttttaggaatctgcaacaagaagtgagaaaagtagaataaagatttttggggctgggcaaagtggctcaggcctgtagtcccagcattttgggaggccgaggcgggcggatcacgaggccaggagttcgagagcagcctggccaacatggtgaaaccctgtctctactaaaatacaaaaattagccaggcgtggtggtgcacgcctgtaatcccagctactcaggaggctgaggcacaagaattgcttgaacctaggaggcggaggttgcagtgagccgagatcacgccactgccctccagcctgggtgacagagcaagatgctgtctcaaaaaaaaaaaaaaaaaaaaaaaaaaaagatttttgggaatgcatggttgcatttagggtttttcaacaaaccatgcaaaaggaacgcaactcggaaaggtggcatctttggaaaggggcaggcctgggtttggatctcagttctgctactccccagctctgtgaacttcatgagcaagcagcttcacttctttgagcttcagtttcctcctggggacagcaaaagtcttatcccacaaagttgggagaaatcagtaagacagtaaggtaacatttacaaatccctccattattcctgccacataacaagccatcataagaccagcgatttctagttgggtgtccttagttttaactttttatcagttgtgtaataccgtcttccttcctggaaattttttgtgtttttttttggggggggggggggtgagcatttaataacctaacgtatgcaaaatacctaaatgacacctgacatacagcaggcactcaataaatgtcagtactccttcctctaccacattccgtcctgctcacacagaaacagctatattcattctactgccttggatttactcgcaccctacactgtacgggaaaatgaataactgcaagaaattccttattttcaaacataccaagaatttccttttaagaacagctcatttttgaacactgattaaggaacaggcccacatgagttcacatatattgctacatttcatcctcatacagccctatgaggtagctcagattcacagaggaccgaaattacagtgacttgcccaagattaggggcatgagaaagggccgagccaggaggtgaacccaggtatgtcaggcctgagggtactcaacagaggcctctttcattggtgccggggcctcgcacatacttgttgggacgttttctcctgttcccacaccccttccttagaatgcaggttttgttaagatcgagtttgttttttagttattttttattttccccaaggcattttctctttgtttctggtagatggggatctgggtccgcagaaatggggaaatgcaaaggaaaaggaaagagagagatcataagtggcagctcttaaggtagcactggtcaaaagatagagactctcaacctcacctgtgcagtccaacaggtgtgtgtgttaagttcttctgcactgaaacactcatatagatggatttatgaccttatggatcataaacagctctggagcggggtgtggggggcagactcttatgtcagagatatgcctaaggatatctttgctttctgaggatacacacacacatacacaatgacgcgatgatgtcaaatctctgctttaactcaagccaccaaatttcctcttctattaaaaccatgaatcaaacttgaacagtcaccagtaaataagaacttacgccatggctggcttcctaggtgaaaaatagcaagcctttgaccacccacccttctggaagatttttaaaaaatgaattgataaactgaagagaacgtctaaagtatgaaaagaccggaaggaaagtgaatacatagatatattagaattcatattacaaacatatctatacctacgtatattatttctacttttatttatctattttaacactttccatgataaacagatggcaacatttgcagtaagataaatattattcaatgatgcatatttctgtatacaaagtgtaatgcgtcgctcaaacaaaacaaaactccattgaaagtgtgaaaaaaaaaacgaaccatcaataacataccctgttttctgtggtctcagaacatctggataggaagaaaagctatacctccaaggctgttagaagcagaggtgatctaaagccagtgaaccgatctttcaaagtcactgctgatgtctaaaagagtcctgagttatctgagtaatgtgaagcatgaggaatttctgccgaaaaatcaacatttcaaaggcgtcggataatacagaaaccccattctactttgtgtgcttatgtagggcggcaggcggggggtgggaagggtaataaaaaattagatttcttaaatgaaacttactgagtaacagtttatctaagaacacgagcaataaatgtggggacttcaagaagagtcactaagggaaagaaaataaacattcattacattaacacacgcagctctctttcattttctccaaaatctattcagaacctgtaggctgatccttgtgacagttctcccaatatttttcctccctttataagggagtccatctgtttcttaaattctgagatgacagtaaaatccacagcttactggagacccagtgaaggaatcagtgtcagccacaaaacagctgcaatccacccaataattctaatatttaagagctttaaaagaggctgagaggaaaaggagagcttgcaaatcttttatggacatgccctctgactctgtctacttgagaaacggggtgtttcctcttggcttcttaagtgcaccaaaaatacaatcagggccttccaccgaagcgcagctccccaaacataaaaaggacaaatgctctgaggctgtgggcatcaggaaggaggaagatctggcttaggaaatgccctatacacaatgcctgcctgacactctctgcaacacacccaccagcaacccaggacacaggttccctctacatgcaagagccaaggctgtccacccaccccatccccacctgcaacagagcactgagctaaagcatcttcttctaagcatgtgtctaaccacctctctacaagagccatctggaaaatcacggggatttgtttctttaaatgtcccactcctgaatctccctccaaagcatcatcctggcagcctccgcagggtctggaaacaaactgcacatttcaacggcctctattgcttgcgaaaaggtctggtcctctccttgcctgcaacccaagctccagctataccagactttgggaacagcctgcccccttctggtctcctggagctccatggaagggcaggaactgggtgggcacagtcagagtaggacagaccccgggctccagccagcctgtctgtactgtgatttcaggatttagcaggtcatggagtaggtgtggggggagaggaaagaaaggagacaagcaaatgaaataaaatacaaagccccaagagacaacagtcaacagcatggtagacagccaccaagaagagaagagaaccaaaagaaaaaaaaaatacataaatgtccatcttggaaggtaaagaaattgagacattaggacatgcagatttggggagagtaactgaacttgcagttggaagcagagtttcagaaaagcaaagcacctccgctgctggaactgcaattccaaaaggaagtaaaaaggaaaatagtgtgttcccacctacctccccaaccgcagatctctcagaggctgagctgggtgtgagagagtaaaacactgagccgagcacacagagaggggctgggggtggatgctcacaatgccggggacctatgaagaaatcagctagccctgcctccttccttctcttcatttgtttcaacaggtgctacatgcatcctaaaggtacctcctgaacccactctgacccccagatgcaaatgatacagtaagccccaggcttcccccaccatgtctcccctacacgttcttacactggaccagcaggacacgacccacaaccctcccaccccacctcctgggctctggatgcacaaagaacttctaattgcatttctgcgggaacccatcactatcaactccaagagttcaaaggcagcgtttcagagtacccctctctgtaaagaagagatcgcaggacactaggaatgttctggttctccgtcaggcagctcacgccactattctccccgcaaatgagggaaagacttctccctgctacccacacagcaacgtgaaatgccatcacatcacgtcttgggactggctcagttctcaggcatgaagagctgcactccggcagaaagggtcgcacagactccgaagaagtttagcagctcagaaagcatcacgctgtgtactaaggcagtcttcagtgaggacttccaaagtgacaaatgatagaaatatgcattcagtcttcaggatcctgaaaccatccccctggtgtctaatatcctttaacggctaggcaaatccttgcagacaagtagtgtgatgaagaaacagacagacacacaacacattggctatgccctaaggcagaactcacgcccctggagaactgagaccttggctctgaaatggggactccggcctcctgccccatgtgctcctgctcctagctcagtaggctgggcaaggcagcccagagaaggtgggaaaggtatccctggagaagttagggacagggtaggaagacaagtcagttccccacccagccacccagatggccccagatctgcggaaaaaacagtttcagagccctgactgttcacacccacgaagggcaaagtaatcccataggagtggaagccctgacggtgtggtcggacacacagctggtgacctgaaccggccgcaacaagacagaaagacagagacaaccagctaggagaaggagccatgccctgaaactggagatggggaggagataaagtcacagagggcatgggagacggcaaggttagagacagagaaggtgaagacggaaggctcaaacatccagagaagagaaacagaagacccaaagtaagaccagacaccccggactgagtattgattcaggggcatggtcggggacttgggacgcccagctcagccctcatcgcaggccaggacgaacagagggctcaactgtctgcacccagctcggcaaaaaccagagagatgctgctgcgacaaccgcccaggaacagcggctgaggatccggggagatccactcactcaggcagggagcgagtcaccaagacctacacgcacggagcaagtcacctggggtccccagcaagagtgatggggaacaggaacccagccaggctccggtaacccccaaagcgcccccgctggagaaaacttcccccagaccccaaggggtccgtgctcagactctgaaaggggcagcccacgacccctgagccttggcagggaccccacccggcttcccggggcaagaggcgatgtggagtcggtaggcttgcagagtcccagtctgatgaccgagttcaagggctaggggggcgtggggtcgggctgccttcctccctccctcgccgcggggcgcgagccgaaagggcatcttaccagagcccgggcgggcagtgccccccggctggccggctgctgtccccgcggttctccggggccgcctccccgcgcccgcgcctggggcccccgtcctcctcctcctccgccgccgcctcctcctcctcctcgggctgcagccggctcggcgggcaggtcccggcgctcccggcgcggggccggggccgggggcggctgctccccgccgccgaccgctgcgcccccgcggcgctccccggccccggagtcgaggctgctgaaattccacacgaccagcgtctgcagcagcagcaccgtgagcgccgcgagcagcgccgagtgcgagcgccgggccagcctccgggcgcacggcgccgccaccatcttcggagcgcggccggcgagcgaggcgcggggaccccggcacgctccgggccgcccccgcgctccccgcagctcccgcggccgccggctgccgctcgggctcccgctcgggccgccgccgccgcccccctccccacacccctgtccccgctggaggggagggtgatggggaaggcgccggggggacgcgggccgaggcggagagggcggggcctgggggaggagccgagggaggaaaaggaggagggaaaggaagggggtgggggcgatcagagaagacagacacccctcaggacgtagtgggagtaggatggggggcgagggggacaattcccaaggcggaaaaagagaggcaggggccgcgaaacaggggacctttggttgagggtgggcccgctcagaatccaggggaggtcaggaagagagggggtcccgaggtcctgttttccctgtgggccgctggaaggaggcagtgcgtggaggaagctcctagccccggagttcgcggtccagggatcttctgtcggtaccagaccggttggcaggtggacacgtgagaaacatttcaggagtgtcagagccacagtctgatcccttcatcctgggcttgaaggggtggggaggaggctttgggtgagtttctggagttaatcagcacaagctctgtgagtgactcctgaatcacacacaatccccggtgccaacgatgtactaagtgttcactgagtcacttctctggtccctgaggactcacaagccaagagactccaaacccagttggcaagtggtatagcggcaaaagggagacccgtggagttactcaaccttcgcaggatgcaagccccaaaggctggccccgcagcctcccagcgtgtccttttccccatccatcctgaagtcccccttcctgtctgcacagggcccaggtcctggggaaacaggtcttgctcttgaaagtggagttctttcccatcctgactggtctgtcccggtgaccttgagccaggaggaggaggactcctccctgagcccaagctttctcctctgtcgtttaggcagaatgatcccaatggactcaaatttcatcccgagccttctctgactcagtctttctggtttttccctcccttgtcctcttgcccagggctttatacacagcagcgcagaacagtgagcatatgggatggcgttggtgtcccatacgggacctagcactctgggaatacaacagcagatcaaatcagtttgtgaattgaggacttggcgtgaatgcttcgcatcttgtctgctgtgctttttcacctcatcctaatttacaaagagaagaaagtggagtgtaatgaaggctcatcagacaatgaggcagggagtgggaagagattgtttcatccactccacaagcatccgtgaatacaaagcttgtgtcagacactgggccaggtgcacgcatccaaaggtgaatgaggtttaatctcatcttcagcaagcctgaggtctagagaagcctgatgtggatgttaatcattaaaatatagtgagataggcctgggcgcggtggctcatgcctgtaatcgcagcactttgggaggccaagacaggaggatcacctgaggtcagaagttcgagatcagccttgccaacatggtgaaaccccgtctctactaaaaatacaaaaattagccgggcatggtggcacacacccctgatcccagctactcaggaggctgaggcaggagaatctcttgaacccaggaggcagaggctgcagtgagccgagatcacaccactgcactccagcctgggttacagagcaagactccatctaaaaaacgtatatataaatatatatatattgtatatatatatattatatataatgtatataataaatatattatatataatatatttatatatatgtacatataatatatataatatataatatataacatatatataatatatatatttatatgtaaatatatataatattatatatatatatatggtgagataagcattgctgtagagatgtgcaaaaatgctaagggttcatgagggcaggacgggagtaagcgccaagaaaaaatgctttctgaacccatgtaattagccagtccacttgcctgaacaagaaaagtataaaatgtatgctagtgggggttgtaaactccaaaccaatcaaccttagttgtatctaaagcttagccaggcatgtagcctggcatagaggccttccctttgggcccagcacccctaaccaggagtaaaagaccagaggcaagtttctagggccaccagtcatctgtttatcagttggggatattttgtttacaagcaataacatctattactaacagtaataagacttaagtctatcttttaagtcttttttttttttttttttttgacacagtctcactccatcacccagcctggagtgcagtggtgtgatctcagctcactccaacctctgcctcttgggttcaagtaattctcatgcctcagcctcccgagtagctgggattacaggcatgtgccaccacgcccagctaattttttttttagtacagacgaggtttcaccatgttggccaggctgatctcaaactcctgacctcaggtgatctgcctgcctcagcctcccaaagtgctgggattacaggcatcagccactgtgcccagcccggtctgtcttaaaaatatactttactggatcatgtagctgaacattgcagaggaaaggcttcaggtgaggtttgatctagcaactcacaattatcacctgggattccttttctttccatctctcctctctgctttccatggagtctaccttattccctcttgatgtcacacgatgcctggcctcagctgctgcgactactttgtatcctgtgttcatttctagcccagggaaaggagggtcagtatttcccaggattttcctcaaaggttcggagattttttttctgattagaccagtcttaagttctgggtcactccgagaccaatcagtgtggccaggaagttagaaaatgccgatcaacttggccaagatcccatatttcacctccgccattggggtgaagccagcctccctgtaacaacttggatgccctatagagatcagggtctgatgggaaagaagtaggtgcagggaacagattccatcatttattccacgcagcctcccgaggttatatgaccttggccaagccacctcccctcccaggacttagatttctttagtgccaaatgaggggttggaggagacagcccccaagatttcacatgttgccagaacgctctcttagtgtctcagcagagcttctcaacccagcagaggctgctctggagcctcttggcaaccctgccctctggctcatctttgcttcaaggtctctggccgcatttttcccgttagcagcaatgatgttatctgcttcctccacatctcacatttaaccacagtcctttggggcccaccctctggctccactccctcaggggccaggggcttaaggagtgaggttaaggatctgggctccaagtccctggagagagagttgtttgtttatctcagacttataaaaagccatgcaagaaagaggtttaaaggctccaggcgggttatggacgccataaacagcttatgtgatggttttaggatgaaaaatcacccgagatcgaagaataggaaggcaagcttctggggtcactggagctgtcttcctgcacctcaagaatctttgggtaaggaggtgagacaaagatgagatcagaacagcgggtggcttggagtgggagaagggcgtgaattttgacgaatctgcagtgcacatgtatctcagtaccagggggcgcagttggtttgggcagtgccagaacccctgggagcaggggccgggcatcatgtcttctaagccaaaccaagcaaaagcagccactttgcattcgaaggggccccggctttggcttccactgtggtgtaaaagcgagacaggcagagcttgatgtataagacagagccgaaagcaccgcctgagactccagcggcagccctagcaacagcagtgagagtccttagaatttttaaagctcattcagtcattcaacaaagatgtattggaccctattatgtgccggacgtcatgctgggaaagcaaactataggcgtgtagaagatttcctaaggaactctgctcttaaaatatcgttcctaatctcacttgaccaagagccagagctctgaagaagccccagactgatctgtgggattccctccccacctccaccccaaatcttgtttcatcgccattttccagtgaaggggggagtaaatcagttaatcagtagttttcagctcctaggtgtgcccagcactgagctcggggctgtgagagaaagtggaaggccagggggaaagggttcttctctctcaaggagctgtcagaagaggtcatgggacaagacaggcgcgggatggggtcagaggagggggcagccacagcggagtcagtgtgcaaaatggttaagagtcagatttcccaggtttactcagctctgctactttttgactcggatttctaagtatcagttgtttacctcgaggcctcagttttctcatctgtaaaatgaggctgataaaagggccattctcataagtttcttataaggattcaatgagataatccataagaaaggctttttcctatagtgactgacacatagtaagtgctccgtaaatgttagatgatatgtgtcttatttatttttcttcatttatttgagacaggttctcactctgttgatcagactggagtgcaggggcacaatcatggctcactgcagcctcaaactcccaggctcaagcaattgtttggcctcagcctctcaagtagctgggactacaggtgcacgtcaccacacccactaattttttattattaatttttattttatttattaatttttatttattttgttattagtttttattagtaacagtagggcactgccaattatgagtgtccaaaggtatccagggctgcctggagaaagtagcactaaaacctcatcctcgactttgatagaagattgcacatacccccaagggttaggaccaagtctcattcatctctactttttctggtgctttgcacagtgcagggcactgaatacattttgggggtggaatgaacactgatctatggggcaggtaggaatgagcctgggatgctggcaggttggaaccccatgcttagaagttcaaggaacccaagttcaaacaccatctcggcaacttgttagttgtgtgatgttaagcaggttagttaatgtcaccaaacctcgatactctcaactgtaagtagtgaagaaaaataatacgtatgttttaaggctggggggttggaggcagggaaatggggcagtgtatatagcagagtgtcatacagtttatacaaaatgatagcaccggccaatagcagtgttgaaggaatattagcctggttgcattggcagggtggtctgtaaagcaatgttctccccttgcctcaatgctcctgccccaggtgccagagagctagggctggatatgccttctgcatttaaataaacttcagcctaagagttaaatttagccaaatacattcttttttaaaatttcgatcatgcatttatttctttttggtttattagagcctgttttcacccagactctacaaattttgctcttgaaaaattaaaaaattccccctacgtttcacttctgcgttgagacagaaatcatgaacaggtgggtcacctgtttctgagtgtcagtgagtggtacgctgaacaccctcccagcccactaggaatcccagagtctctccaataagcatttgcaagtgcaaggattccacgtggaggtcagaggagccaggaccttgaacgtccctggagccccacccacagcatgcgaggtcacagacagacaggcatcacctgtacctctttccccagtgcaagagaaagaaacagcctctgatcagaccacaggcataggcaggtgacaaaccccgccaggagcccagctgtgcttctgctgaaatccgcaggcttccaggctaatcatctacccaatgcatcagcagagggagctctaggtagtaaataacattcctctgactgcagagtttcctgtaaaaaaaatctggagacagcaaaggaaagcgaggtcctatgtggagagggcacctaccatgtgtgcagaagaaaatcacaccaatttgcaagagtagggtgttggggcaggagtgggagatgggaaagagagaagaaaatcagaaagcaccacattgcttaagagatgatctgaatttgttttgtctcagcactttgaccttctaaggactcacagcctctatgctacccttgcaaggctctgatgtttgaaaaggggacgcagtccaagtctcagactacactggcagacattttttttctttaaatgttgattgtgggctgggcgtggtggctcatgccttgtaatttcagcagtttgggaggccgaggcaggtggatcgcttgaggccaggagtttgagaccagcctggccaacatgacgaaaccccatctctactaaaatgacaaaaattagccggggatgatggtgcatgcctgtagtcccagatacttggaaggtggtggtcacaatgagccaagattgtgccactgcactccagcctgggcgacaaagcaagactccatcttaaaaaaaaaaaaaaaaaaaaagttgattatatgtgttatgggtgcctaatctaacccctggggccataggcttatttatgactgtggcaatgacaaggatgacaatgatgacgatgacggcaataagagcgaacatttattgagcacttactaggtgccaagccgtatattgaggacttcaacaaatcatattcaccaaatatttgttgagaattgattcaatacttaggacagtgttcatgccagggattcatgggaattcatccacggataagacacagaaagtccctcctgtcatcaagcttgcattctaaggaggcagacaggtcaagacaaacaaatatataaacaagtaatatcagagagtgataagtgctatgaaaaaaataaaaagaggctgagcatggtggctcacgcctataatcccagcactttgggaggctgaggcgaggcgggaggattgcttgagtccaggactttgagaccagcttgggcaacatagccagacctcttttctacaaagaaaaataatttaaaaattagggttggtagtgctcacctgtagtcctagctacttgattctttgtgcccagaagttcaagactacagtgagctagattgcaccactgcactccagcctgggtgtcagataaagaccctgtctcaaaaaaaaaaaaaaaaaaaaaaaaagaaagaaagaaaaagaaaaggaagctgacttgctagagtgactaaaataggacaaggggaaacaggctggtcagggcagaccttacccagacaatgacactggagtgttgataaccttctcaagaaatgtgactgtttaacaactcttactccatttatgcatcaagcatcatctactgactgaacaaataactgtagatccatttttcaaatgtgtgatatataaatgatgctaaattcattgtcattctttgggcattttggattttcttaaagtgattagtaataactatttgcatggtcatgatgggagctatggaatgggttaggaaaaagttcaccaaaaaagaaaagagttaaaaatatccatctcaccaaagaagaattgagagcaactaatgtattagatctcaaatatttttggtccaaatacttttttaatttcttaactttaccctcctcacccctctcaaaggttctgtatgccacagatgtttctatttagcccctgtatctttaagtcggcaggctgagccccgtagtccccaaatcacctctcccatcttgtttgtagcttcttctctgcaccccaatgtcaacccatcctgcacctattgctatttctctctgtgtctctcaaatctcttttacctgaacccctaagaattctattccacaagggctaagtgtacggtgttgggggcgggagtgggagatggggaggagggaagaaaatcagaaagcaccacattgcttaagagatgatctgactttgttttgtcccagcactttgaccttctgaggactcacagcctctgtgcttcccttacaaggctctccttgcacctgccctctaagaactctattccacaaggaaaacagaagttcactggaagcctgtttgatatgccagagtctgttagctgcttctcaaatacccattcttcctttcctgtttggtcaagaattctgattttagttggggtgacaatgagcccaaaccaaaagcaacggttcttagccttcctgtaagttaggagtgatcggaaagaagacagcagatacaattggtagagctcccaagaaatcctttggggtgggagggaagatcctaaataagttgggattgagttccctttgtgccttgccattcccattgttttttttctattcttaacttcagacagggtctcactctgtcaccccagctggagtgcagtggtgcaatctcggctcactgcagcctcgacctcccaagcccaagcaattctcctgcctcagccccccaagtagctgggacacaggcacctgataccacatctagtttttgtatttttagtagagatgggggtctcgccctgttgctcagtctgatctctaacttctgagctcaagcaatctgcccacctcaacttcccaaactgttaggattacaggcatgaaccatggtgcccagccatcattcccattcttttggactggaatgtagaaaggatagctggagctccagcagccatcttgtgaccatgaggacagaggccagtactacaggtggtgagccagaaagaaagaaacagcttgggttcctggtgctctgctgtctccggcccatccttagacttttcttcacacccaagaatgagccccatattagttggagccactcaggctgggtttctgtctctatagctggtacgatgacgtgtctgatagaatgaaacagtctaactgaaagaagctcagggatagaggtgggatttgggaagagctggaaccagggacccaaacacagaagtcacccgctttatctcttgctctgcttccttctgcctgcttgattaattctccctcctggcagaacaatgctgtccacatggtaagaagcataactgccacagctcctgagtgccacactgtacagcctccataaagggacaggttctccctctaaggccatgagccgcaagcgggtcctcaatgctgtctcattcgctgcattttgctggtcttgtcactctcccaggcatgaagccaccagctctctctcccctcctgcctctgactttcctccttccccacttgcctgaggaccttgcttcccaggttgacaagggagggggaaggaagcttcccaccaagctcctgccatttaatttccccacttttctacatcggtgtcgcggactgtttttgtgaatgaactttctaggctccaggtcgagacccactcctccatctgccaaagagaccccaccttgtcttacctatctgcggacatcactccaacacttccattttctccttcctttatcatcagttcttcctcccgagagcagcatttcctctagcatttgaattccctggtatttctctggttaaaaacaaaagttctgaccaggcgtggtggctcatgcctgtaatcacgcactttgggaggctgaggcgggcggatcacctgaggtcaggaatttgacaccagcctgatcaacgtggtgaaaccctgtctctactaaaaatacaaaattagctgggcatggtggcacatgcctgtaatcccagctacttgggaggctgaggcaggagaactgcttgaacctaggaggcggaggttgcggtgagctgagattcggctgagctgagattgcaccattgcactccagcctgggcaacaaaagcgaaactccatctcaaaaaccataaaataaaaaatgttctctcctggccccacagccctctatagcttcgatctcgtgtttctctttcttttgcaggaaaactcctcaaaagcattgtctagctcaccgtatctccaattcttccctttccatcttctcctaagcccttctaacacacacacacacacacacacacacacacacacacacacacacgctactcttaagctcatcagtgacctcattaccagattcaatagttacttagcctaatgcaacaaaggtcacagttgtcccttccttcctccttatttatttctttggcttccaggatgctgctctctgggttcgctcctatctcacagctgttccttctcagcctctttggttaatcccttctcttccagctgtcctctccccttccttaccccaattttctgtgctggcttttcccaggctttaattccatagcttttcttctccaccatccagatgcatggctataaagaaatcctctaattcacatgtttatatttccagcctgtactcctccccaaactccaagttcatgcactcagttgctcacccagcatcgccacttggatgtctaatagacatctctgtcaagaactgaaaaaggggctggggatttgaccctacttgcaaactaacaaggtattctgccatagcttcatgaattccagcagaagacatgagactcctggatcagagacaaaagatcctattacccacctcatagcaggcagcatgagcttcatgtttgcatcagttccctccctgcatcccccaccaagtctctggggtggtacagagggggtcaaggcagatgctctacacatgactgagaaacctggagttttgaaaaactctgtattttataatgagctgcaagcaaatctgctcaacctttgccccagagggagacattatctttattagcctgaatagcaaacaaatctgccctctgcccagaagggagacactatctctgcctactaaggctgttcacaatacaaatatgaagtttatatgccttttgatgtcttgaaaaggtcatccggaggccaggcatggtggctcatgcctgtaatgccagcactttaggaggccaaggcaggccgatcacttgagcccaggagttcaacatcagcctaagcaacatggagaaaccccatctctacaataaatacaaaaattagctgtggccagacatggtggctcacacctgtaatcccagcactttgggaggccgaggtggatggatcacctgaggccaagagttcaagaccagcctggtcaacatggcaaaaccccgtctctagaaaaaaatacaaaaaaagtagtcaggcttggtggcggatgcctgtaatcccagctacctgggaagctgaggcaggagaatcacctgaacccaggagttggaggttgtagtgagccgagattgccccactgcactccagcctgggcaacagagagagactccatctcaaaaaaaaaaaaaaaaaaaaattaactggaagtggtggctgtgcccgtagtcctaaatactcaggaggctgaggtgagaggatggcttgagcccggaaggcggaggttacagtgagccaagattgcaccactgcattccagccaaggtgacagagtcagaccctgtctccaaaaaaaaaaaaaaaaaaaaaagtcatccagaatagaaagccacaatgtgcagaaatataaacagcccatggagaattatttcctaacagtattaaacttatcatatccaaaatggaattcttgaacttccttcccagctcatgccaccaaaagcttttccatatcaagagctttcagtcatcacagctcctgtcttttgctcgtaatacgcacccaattcatcagcaaatcctgttggcttcatgttcaaaatatttcccaaatcagattacatctcactgtccccatggccatcacttaggtccaagccacattgtctctcccttgattccgcagtcacctcctaattcacagccctgcctccaaccttgctctgttctctccacagcagccagagaaaacctgattaaacttagctgcagtgttgtcattcattagttaacagcaacatcaaggggatcctcatttctcttagaaataaagccagtgttcctataagagcctgcatggcccccaccatccagcccccagcatctctctcacctgcacaagctattttcctgccctttcctcacacccttccatcaccctggtttcctttcagtttcttaaatacgccaggcaggtgctcacctggcggcattgccctggtttttcattatgtctggaatgctgtgcacccagatatctgcctgtctccctcccttaccttgtctccctgcctttttcaagcttctgaagaaggtgtcatcttctagttacagtagttagctagtcagacatgaacagggcaggagagggctcctcccccaccactaggaatgtcaggcaaccatggtcaggcagctgttaactgtctctctaaaataataattggttgcagtcagcaccagggaaaggcagtttcccaatgaacagaaatacctgaaactggtgatcagcagcttcccgataagatctcaagagttgggcaagtaggttcaagcatgcacactaagaggcaaaatggcagagtttaactggtatatgacctcctggggacatctgactggtaagggaagaacgctttaactgagcatgcgtacaactccaggaagcacactcagcatgcttctctccaggccactgctccaggtaacatcctgccccaagggaagaatcaggggagaagggacgcaagaccccagaagcatgccagtgtatgaccccaagtcaaaggtcaaacagcgcactttatctctcaagtcgcctgcttggtcctcttccaagtataccattttttgtttcattcctgctctaacgcttttttttttttttttttgagttggagtctcgctctgttgtcgcccaggctggagtgcagtggcttgatcttggctcactgcaaccttcccttcctgggttctaagtgattctcctgcttcagcctcccaagtagctagaattacaggcatgcaccaccacactcagctaattttgtatttttagtagagacggggtttcaccatgttggccaggctggtctcaaactcctgacctcaggtgatccacctgctttggcctcccaaagtgcggggattacaggcgtgagacaccacgcccagccattcctgctctaacaccttttttttttttttttttttggagactgagtctctctgtcaccaggttggagtgcagtggcatgatctcagctcactgcaacctctgcctcccaggttcaagcgattctcctgtctcagcctcccgagtagctaaaattacaggcacccgccactacgcccagctaatattttgtatttttagtagagatggcgtttcaccatgttggccaggctggtctcaaactcctgacctcatgatttgcccgcctcagcctcccaaagtgctatgattacaggcatgagccaccgtacccggcctctaacactttttaataaactttcactgctgctctgaaacttgcctcagtctctccttctgccttatgcccctcagttgaatcctttcttccgtggaggcaagaattgaggttgctgcagacccgtatgaattcatcgccagtaacattctcatttaagcctttcccaactatcgcagtggaatcacagtgcctcagccagcacccccaattgccttgactttgttttattggtctccgagcactgaccaccttgttcacttattctatttattgttgtctgtctgtctgaccccattagattataaagcccatgagggcaaggttttgtctgctttgcttactgcttagtgcttggcacatggtaagagcttgattaatgtttgttgatgaattgaagttgaagtcagagtccaaagacattgcagaaaacagcattgattatcctgcctcacctggggcgcaatgactggagttacaggaaaggggtcacataagaagacagagaaggatccggtgtggtggctcacgcctgtaatcccagcacaacaggaggctgaggtggaagtatggcttgagcccaggggttcaagaccagcctgggcaacatagaaagaccctgtctctacaaaaaatttttatttttttatttttttaaaaactttaagtcctgggatacatgtgctgaacatgcaggtttgttacataggtatacatgtgccatggtggtttgatgtacctatcaacgcagcatctaggtttcaagccccgcatgcattatgtatttgtcctaatgctctgcctcccctttccctccaccccccgataagcccgggtgtgtgatgttcccctccctgtgtccatgtgttctcgttgttcaactcccacttatgagtgataacatgtggtgcttggttttctgttcctacattagtttgctgaggatgatggtttccaacttcattcatgtccctgcaaagaacgtgaactcattctagctgggtgtggtggctgtgcacctgcaatcctgctactccaggaggctaaagtgggaggactgcttgagcctgggaggtcgaggctgcagtgagacatgatcatgccactgaactccagcctgggcaacagagggtctctaaaacaaaaaacaaaaaacaaaacaaaacaaaaaaagcaaaaaagaggaagaagaagaaatgagaacctatgttaaccatgtaatgaaaaagccactggcaagaaggggagacaccaactgtgctgttgatgtcggaggcagggcaacagtgggggaacaagaccctggacccaaaccacttgggtttgaatctcccatgtacttcttactaactctggtgtgttggagagattgtttcattttctcctttctttttcatctgcaaaactgggggaacacggtactctcctcctgcgattgtcagggggcttaaatatatgaattaatgttaaaaagcactcgaagtagcactcagcacatagtaacatcaaatacaagatctgaaaactgttagaaaaacaatgagaacttgataaaagaaatacatatatatttgaagaaatcaatatgcttcttttccatagcaggtagataaatagaaagaaaaatcagtaaggacatagagaaattgcacactgcaacctacaaactcaatttaatagatacatagagaaacacttaccttaacagaaagtaaatattatcttctaatatccacggaatctgtcatatacctaaacataaagtaaacctcaacaaataaaataaaaaagatttttctcaagccagattctccctaatcataatccaatattataaatattttattttatttgttttaataacttaaaaagtgagaaacaccaccctagataatggaatttaatcttttttagaagagcaataaataagagaatatcacaaaatcaacagaatacaacaaaagctatagtcagaggaaaattaatagactgcaaaaccttcattataaagaatgactaataagacaatgaagaaatgtatgagcccagaggttacaataagaaaataaaagaaattctccataaaaaataataatgacagaaactgaatgtaatgaaatggaaagcacaaacaacagcagaaagtaaaaaatcaactcaaaaactcattttttgaaacaccagattaaacccctggcaagtctgatttagaaaaaaaataaataaataaaaataaaagtatagctatgtaaaaaagaaaacttagccaaaatcacagaagtaaaggaaaattgaagagaatatcacgtgcaattctatgccaatacatttgataacctggattaagtggctaatttcttgggaaaaaaataaacattaaaaatggcccaagacaaggcagaaaacttggagaaaccgatgaccagaaagagatggaaaatttaccagatcagagaggttcaaagctgagttgtatataaccttatgtgtaataaaaaggattgctccaatgttacttattccaagttgtacacagttgttctcagacttgactgcatggtggagtcacccagtgagatttttaaaactaatgatgtccaaatcccaccccaagaaatatctattcaactggtgtgggctgtgccagctatcagcatcttgaaacagttctccaggtgatacaaatgtgcaagccaaatgttaaatcaagtgtagcctaaagctgtcttcttatgtattcaagtttggcctaaaggtttttctgtatctgctgaactatagcaagtggaggtgtaaacagaccatagcctccgcttgtgacaatcactgagttttggccaatcaaatgtagccaactgtttgaaccatgttcaaataaggcaaacacgagctgtaaccaatccagctgtttctgtacctcacttccatcttctgtacatcacttgtctttttctgtccacaaaccttcttccatcccctggctgtgctggagtctctgagcctaccctggctgggaaggctgcccaattcaccagtcgttcatggatcaattaaactcctttaaatttaatttgcctgaagtttttcctttatcacaaggttgctagcccctgccatagaaaggaatgcagagcttttcaattaaaaaacaaaaacaaaaaacaaaacaaaaaaacccctcagttctggtaaagatagcaccaggaaagaaaactataagttaactttacttatgaaaaaaaatgaatcttttgaataaactaccagcatcaaaggaataatgtgttatgaccaagcagtttattccaggaatttaagtctgggttgaatcaggtaaggtatcaacataatccaccagttccattactctgttaaagatgaagctgagaaaccatttgattacacttgggagtcattcttaagaaatcaccaagtaaaccattaatagaaggaaattaagtataatgcaggctaacgaacaaaaaattactcaaaatggcaaaaattaaatcttaatgcatttaaaagttcttgtaaatgcattaagataagaaaacaaaataatctgtaagtattgcaaaagaaaaactaaaactctctttttgctgttggtttgcttgtatactatattagagttctacatagataccaaaccaataggatataaatatagatagatatggatacagatatatgagatggggctttattagcggcattagctccgatgataatggaggctaagtctcaggacaggctgtctgtaggccggaaagcctaggatgccagtagcctggctccattcaagtccaaagcctcagtgtcagaaaagccagtggtgtaactcagtccaaggtcaaaggcctgaaatgaaaggggcattgagtaagtcatgaagtcccaaggccagacaccctggagttctgatgttgaagggcaggaggaaagtggcccacctccatgagagagagagaggagaggaggtatattagtctgttctcatgctgctaataatgacatacctgagactgagtaatttataaaggaaagaaaggaaaggggtttaatggattcacagttccacatggccggggaggcctcactatcatggtgaaggcaaggaagggcaaatcacgtcttacacagcagcaggcaagaaagagcttgtgcaggggaactccaatttataaaagcatcatatttcatggacttattcactaccatgagaacagtatgggggacaccacccccatgattcaattatctccacctggccccacccttgacacatctggattattacaattctaggtgagatttggttggggacacagccaaaccatatcagaaggagaggaggagagtgttaccttctccaggagagactgtccgtttctccaataaaaggagaggaaattctttcctttctcatattttgttccacctgtgctccccactgattggatggtgcctgcacacttggagggtagatcctccccaatgaatctactgactcacatgccagcctcctctggaagcaccttcatagacattccaaaagcaatgctttatcagttctctaggccttccttaatccattcaagggtaacctaaaatttatcatgacatatactaaagaaacctaatagactctagtaaaaaacaaacgaacaaacaaaaaccctactacaatcaataagaatttgtaaaggaactggaaacagtagaattatacaaatattaataacctttctctataccagcagtaagaaccttgaaatagatatggcaggaaattagatggaaaaatattctagttacaatagcatgaactataaaataacttgggaccacttaagaaaaaagacttgggaattataggaaaactatttgtaaagtaatgcccaaaaatctcattgaatttcataaaacacgatccacacaaacgaaaataaatgctaagtcttgcatgggcaagttgatataaaatataaatcttacaaaaatcaataaaattaacttcaagttccaatatcaataaaatatcaacagcttgcttttaatggtgggtggaggggaaaagggagattggattaaacgaatggaggaaggaatacacttgaatgaccaaatggaaataaatacaaacatacactcatatatgtatacaaggcagacatatacttgccttaacatatatcagaatataccataaagtcaactataaacaaataaatatgctgctagtttagaaataaatagatcaatataacagaactcaaagacaatatttgaatctggtagggaaatatggtttatttgaagtatgttgctagcccaactgattttccactggaagaaaataatgtcggactcctataatataccatatattaaaaaaacaaatccaggctgggcatggtggctcacgtctgtaatcccagcactttgggaggctgaggtgggtggatcgcctgaggtcaggagttccagaccatcctggacaccatgatgaaaccccgtctctactaaaaacacgacaaaattagctgggcatggtggtacatgcctgtaatcccagctacttgggaagctgaggcaagagaattgcttgaacccaggaggtggaggttgcggtgagctgagattgcaccactgcactccagcatgggcaatagagtgagactcggtctcaaaaaaaaaaaaaaatttaaaaacattaaaaaaaatttgtgttaatctagatggagtaaaatcttaatgtaaataaaacaacaatggggttttttattttaaaaaataaaaatatttggtttaatcaacaaatgaataaagaaaatgtggcatagacatagacacacacacacacacacacacacacacacacacacacacacacactccccagggaatactactctgtgataaaaaggaacaaaataaaggcatttgcagcaatctggatggaattggagaccattattctaagtgaagtaactcaagaatagaaaaccgaacgttatatgctctcactcttaagtgggagctaagctctgaggacgcaaaggcataagaatgatacattggattttggggactccagggaaatggtgggggcagagtgagggataaaagactacactttggggccaggcacattggctcatgcctgtaatcccagcactttggaaggctgacacgggcggatcacctgaggtcaggagttcaagacaagcctggccaacatggtgaaaccctgtctctactaaaaatacaaaaattagctgggcatggtggcatgtgcttgtaatcccagctactcgggaggctgaggcaggacaatttcttgaacccagaaggcagaggttgcagtgagctgagatcacaccattgcactccagcctgcatgacaagagcgagactttgtctcaaaaaaaaaaaaaaaaaaaaaaaaagaaaaagaaaaagactacacattgggtacagggtactctgctcaggtgatgggtgcaacaaaatctcagaaatcaccactagagaacttattcatgtaattgaaaaaaaacaatgaagaattcagaggtgatagaaaacaaaaagcagcacttttggaatatactatgaaaggaggtagtggaggttatgagaggcgtcagaaagaagacaattttgaacaacgtgagccctatcaactgaggaagcatgagaaagatgtgtagcatagtggacctgtgctaagatgtatagcatagtgtagtgtagcacagtggagactggactaccattcagcaaagtaaaggaatgaagtactgattcacaccactatgtggcaagtctttaaaacatcattatgctcaggagagaagccagacacaaaaggaccacatgctgtatgattttatttatatgaaatgtccggaaaaggcaaacctattgaggcagaaagtagattaatggttgccatgggtacgttgtttgttttgggggtgatggaaatgacctaaataaaattaggttgtggtaatggttgcataactctataaatacactaaagcaggtgagttttatggtatgtaaattatatctcaataaagccatgaaaatattaatgccactacagttacatttattaactatgcaaagcataggatgtcctattccaccaagagtatcaagtacagattttgtgtgtttgtgtgtgaatgggtacataccatttcaaataggtcaattgtcaaaaattgaaatgcgagatcagtaaactgccatcacctaaaacttcaaaggggcatgtgactagcttagcaaaggtacacatggcgatgaaacatgccagctctgggggcagaccacgctgggttcaaatctcagttccaaaacttactccttgtgtggcacatggcctcagtttccctatctgtaaaatggagagagggttgttgtgagaatgaagtgaagtgatgtgtgtcaataacagataatccttagaacagagtaggacctcaacaaaactgatggtggtagtggtggtggtagtgattaggattagagtagagaaaggatcagaggagtcttatgagatgtatttatttgtattcattattaccttttatttatatggatatatttgcatatatggacattttactttaaaattcacagtattatccatggtaagttgtcatgtaaaagttccaaaattgttagagagacagaaaattgctggctattgccaaagtcatttatatactgggaggaaaataggtgctatctttaaactttctcatcagtatacctaggatgcggcgggggaagaggactccattccatttgtggtgttggaatcgcaccgccccccacccacaacggttccttttacaggcagtggaaacagctctgaaaagcttgctttgggagggacacccagcatgctgagatgtcacagtggtgctcaaggaagctatcattcatactgctataatctaacacagtgatggggttctgggtcagataagacactgctaattttttaggccaaagaaagagatgtatttttctgtaggctgttatgtgtttgtttaaaaatcatgtcattccagcctgggcaacctaacaagacccagtctctccaaaaaaaaaaaaaaaaatagctgagctaacaagtacatctgttgccccatctgttcaggaggctgaggcaggaggattgctagagcctaggaggttgaggctgtagtgagccatgattgcaccactgtactccagcctgggcaacagaaagaaaccctgtctcaatcaatcaatcaataaaacatagaaagaactgtttgggggtactggaaatgatatataaccttggtttgggtggtggtacactggtgtatacatgtgtaaaaatcagctgagctctatacttaagttgcatatactttatatattttatatttcagaaacagagaaagatcagaatctaattcaaggaaacattcctgtacacacaaaaatagtcatcatatcttatatgcaaagatagtcatcatagcatctttgcaatagcaaaacatctgaaacaatctaactttcaacaatattgtctaatggttaagtaaattatggcatatccactaattagaatatttatataactaaaatgttcatgaagagtttgcaaaaacatggagaaatgccatgtcatcaagttaaacaaaaaaaatcaggagctaaactccttatatgtgatatgtaaacataattatattaaaatatgcataaaaatgatgacagaaatgccccaggctttaatactgaccatttttcagtggtgaaactatggaggattttcctttcttctttcaaattttctgcacttataataaataaatttggttttcataattgcataaacataactaatacttttaagtttacaatagcaaaaagcaaacattggaccaggaatcaatcttgcagtgattaacagcatgggatgcttgcagctgcagacttggtgtcagatgctggtctttttgctttaaaagggcagtcattactatggctaaaaccaatttcgtaaggagatcaccatcaggcttggcattacagctctgttgaagcctcctgacatacagttttgagatgcgcctcctggtcagaaaatagtcggctatgtcctaccaattaaggatttctccttcatcaccagaataagctcttcggataacttatacttccaagcagtttctgtgcagccagcactggataaaaatgctatcaccaatggagtttgaatctcccaagatgacaatatatccatatatagtcatcctcggtgtctgtgggggattggttccagccccctccctccaatactaaaatctacaggtgctcacaccccttatataaaatgccatagtatctgcatgtaacttaggtacatctgccagtatactttaaatcatctctagattacttatgatacttaatacaatattaatgctatgtaaatagttgttatactgtattttttcacttgcattattttttgttatattgttatatatttttcctgaatatttttgatttgtggttggttgaatctacggatgtagaacccaaggatagttctagagaaggctcctttgtacctaaatttggagcattccaagtatcctccaaagccttctactactaaaggaagatacacatttttgggaggaggaacttggaggaatttgggcttgatctttgaacaagattgtctgatgaagacacagatgatagcagcattaaatatcctcactgcatttatcctttagtcagccatttattaaatatttattgagaagcagagcttgcactaaactccattatttttaagcttacactaggggttggcaaataactttcatcctgtatgcctaatttgatgggttgatagtggtgctctcaaatgctctcctggaaaagattctgggacagggtccaaactcaagtgaaaagagcaatgatcgattagtaatgtctcccattcttgcagaaagggaaatggtggtatatatgctatgctggccggatatttttctgccaggttaatgactgtcacttaagccttgacacacactctctttccttacaagttaaaggaaccaaacttctatccaagttaacatcactggagaagcactaacagagggggaaatagagacatgtttgttagcaatctactacattctagaccttgcagagttctctttacatatactgagtcatgtcatttttaggatatcccttcaaggtaagcatccttatctcctttttacagataaggacctaggcgaagagaagcaaaataactttttgaagtctcacaatcagacacagcagaatcactcttccatccaatgagaaacccaggcttgatatggaaccaagtaagataagacagtgtccccttcttttcagaaggttataaaattaattctacaaatttttgataattacctgagttaaataggtccctttggagaagtattcaatccagtttgttcatcaagacaaaaggaggcacagtcatttccactttctcttattttttctttttttctgagacagagtcttgctctgtcgcccaggctggagtgcagtggcatgatctcggctcactgcaacctccgcctcccgggtttaagcaattctcctgcctcagcctctggagtagctgggattacaggtgtgtgccaccatgcctggctacttttttattttttatttttagtagagacgggatctcaccatgttggccaggttggtctcgaactcctgacctcgtgatctgcccgcctcagcttcccaaagtgctgggattacaggcgtgagccactgcgcccaacccattttcactttctgcccactcccatacaggcaagcactagtgtccttcaaagagggtggtactcatatcatccaagcagcaacatcagagcattttgatcctggatacaactgcacactctatggatgagctccagcaaattcaactgaccctgtttttcagtgtggttcaaatgtctgtgattatttggtggagcagtcatgatctcataaaattacatataattacaaatttactaagtgccaattcctctgctaagggctccagctgcactatggtgttgcatcctcacactatctctgtgacagaggtaacatcattatcctgattagacacatgaaaaatatgaaactttacagccaagaaacttagtcaaagtcacagagctagtaaggtagggctgaaacttcagcccaggccatcagacctcaaagtctatggcttaacttcaatttaaactgtttaatcaacttccagttctggctagtttccagtaggtcttccctagaggaaaggacacatatttcaggacaataatttcagtggaagttatatatttgagtagagatctcaggaagcaccagaagaggactggagagtgagacagggaagagaagggaatttatctcatcaagcaacttactctatgggaaactggagtccaatatttcttggagaactctgggtaacaatgtactaaatgtaaccccaaaacaagggagctgaagtatttatacaccctttcttagtagttattggttgagatctgctctcacagaacatgaattccttggcacttcaagtccgccacacatgtggagagagtggatgctggtggccagaaagtacccttaggcaaagaaccctaggactggaggccaaagccagtgagcctatgtagaaacatgagggcctaggaaatgtgggcagcaacaactgccaaagtctaccttcactttctttttaatttcaattttcaatttttgtttattttttgtaaacaggatcttgctcagttgcccaggcagaggtgtggtagtgcaatctcagctcacagtaacctcgacctcttgggatcaagcgatcctcccagctcagcctcccaagaagctgggactgcaggtgcatgctgccaagcccagctaatttttaaaattttttttatagagatgggatcgcactatgttgcccagccgggtatcacctcctgggttcaagtgatcttcccactcagcctcccaaagtgctgggattacaggcatgagccaccacacctggcgcttctctcttttaaataaacaacttgatgagttgatgggtgcagcaaaccaacatggcacatgtatacctatgtatcaaaactgcatgttgtgtacatgtatcctagaacttaaagtataattaaaaaaattgaattacttactttaaattggtgaatggtatggaatgtgaattatatctcaataaatgtgtcaaaaaaaaaaacaacttgactgaggtgcaaattatagatcataacatttaccaattttaagtgtataatttaacaactcttggcaaatttacagagttgtgtaaccatccaacatcatctatttttaggacattttcatcacccagtaggatcccacatacccatttacagttacttcacattttcactcccagccccaggaaaccactaatctactttgtctctatggttttgccttttctggacattttatataaatggaatcatacaatatgtggtcttctgtgtaaataagaaagtccctctccaaatggataacactgtagaaatgaaaaaaaaaaaaaaaggagggggataggcaagtaacttctagcaagagacttctccatatgggaggtgggaatgttctagatgaaacaaacaatgactataacgcaactggcaatgaagagacaccccctgatcactgtggaatctcatcttccccaggatgcatttgcatatacaagcttttgagtgaatgtattttgaaggaatcttttgcatacaaaggactagcaggcagcaagctgtgggttaagaggctttgaagcccattaaaccatcaacctcaacatggaaatgaatgggatcaaatagtttctgatggtttcaggagctgaaaagggtcagtctttgggagtgactgatgtacaaagggatctcggtttcttctcaggcttgccaatccctttatactttccccaaaccttgtacatgttaatgaaattgacacaacattaatggaaggcaactagagcagaagagctggtcaacggtcaaccaccttgtgtctccaggacagccatcttccaggaaactgaagcctcctgtcacacagactttgtgtctgttggataaagtggttaaaattccccatgcacaaggcataattggctcatgactaaccgtctgcagaaacaaccactgataaatgcaaataagatgtgggatgtgggatgtggtccacatcatctcacacaaaacagacttcagcctcctgctgaaggtcaatttctccaagctgtttctgctccttgattctggaccaacccatagagtagaattttgactattgtccctctggggatccctgtcacgtgctactcaggagcacccattttttttttcttttgcattgtgaacaaatcgaggaataagcataacaacaaatgactggccaaaataccagctttattgttggtaatgccaggccagaaggtaaggcttatacccacaaccacagtgtgtttccctgatacatacccctgagcctggatcctcaaatccgttaaagggaaacagcagaagagcagctgcaaaggagctagtctgggccccaggagtagagacagaaagaagtgcacgtctgctcctctctctacaaggccagcaccaagccctgacccaggcatgctgatgccacgtatgacaccctcatccagggacaagcccagagctccaaaagaaagtccaagggactgatgccctccaccctgagatttcatctttccaatcttttcttatcagatacgtgatttctccactcttgtagaaaagacagggacaaggtgaagggaaggatagaagcttccttttgaataattccaggaggtagagggtgtggtgatgaaaaatttatattctttggactaataaaaatattagattagaaaacaagggccaggagtagtggctcatgactgtaatcccagcactttgggaggcagaggcgggtagatcccttgagcccaggagtccaagaccagcctgggcaatatggcgtgacccccatctctataaaaaataaaaaaattagccaggtgtggtggcatgcacctgtggtcccagctgctcagcaggctgaggcaggagaactgattgagcctgggcagtcaaggccatgatcacaccactgcactccagcctgggtgacagaacaagactctgtctcaaaaaaagaaaaaaataggctgaggtgggcagagcacttgagctcagtagttcgagaccagccggggcaacatggtaaaaccctatctctacacaaaatacaaaaattagctgggtgggatggcatgtgcctataatcccaactactcaggagcctgaggtaggaggatggcttgaccccaggatgttgaggctgcagtgaaccttgattgtgtcactgcactccagcctaggggacagaccaagaccctgcctccaaaaaaaagaaaagaaagaaaaaaaagaaaaatttgcctgtaagagaaaaaataactttctctcttatctctgtctccctgccgatacacacatgtgcacatgcatgcacatatgcacaaacacacacacgaggagttgaagaacttggattcttgccctgcaaagtattctttcagccctactttcccatgatttcagaatctataagagccttatcttagaatctaccagctgcagagtatgctgtttgtagatgccctgtctatctctgctggtgcttccagtaaatgtgtagccaggacttgcccactcaagcctccagggttccagcaggtaaccaaagctaatggaaggggccagctataggagaaaaggcagcactggggactttggtgacctggagagcacaggctgccccactccagcttattactgtcctgcgggaatgcaggctcactgttgcccaatctctctgagtctcaagagaaggaagccattagcatttatttttgtgtgcaaaatccttagctgtttaacagctggctctgtttttaaaaacattgcttgtttgggccaaatgaaatgcatctgccaactccatttaacccatggtcagctgcttgtgattctggtgtagaatggccacatgggcaatgacatccatccttctgacatcctgggccagccatggaaggaaaagtagaaatttgctgtgagggcattggttaggattagtagtccccagggatgctcactattgcctgtggtagtgtctcaaactccaccattagaagtgtattccctcaaggccgggctcaatggctcctgcctgtaatacccagcaccttgggaggctgaggcaggcggatcacctgaggtcaggagtttgagaccagcctggccaacatggcgaaaccctgtctctcctaaaaaatacaaaaaattagccaggcatggtggcgggcacctgcagtcccagctacttgggagactgaggcagaggaatagcttgaacccaggagatggaagttacagtgagctgagattgtgccattgcactctagcctgggcaacagagcgagactgcccccccaaaaaaaaaagtttattccctcgaatcctcagggattatctatgtccaaagtccccagaggactgcaagtgtccctgagtcatgtcccacactttgggaggcagaggcaggtgaatcccttgagcccagaggtccagtccacttccagaggactgcacacataaaactgtgacatcagcttctgggggctgttcttgtggtcatcccgtgcccaccttggagactgtaacagcatccccctaccctcaacactcagactcacccttaaaagcattgataaatggcagattttagtacagttttcttgagagatggagcagaggctgacagggtcctgtggacataaaacttcctcctaatcccctctgaatattccccatttagaatgccacatgcaggatttaaaaaaaagtctcccttctttttccttcttagggaaaatgctccctctgaccaataccttccaagaaataaaaacacaagtaaaatccccccagccagtggcttctccagccaaattggtcccgtcaaccttcatataccttcaggaaagcaaacatctgctaatttcatactgacagccaatatctatggagcacttaatgagacgggcactgttagtagcacttctcaggtacctacctatatatgtatgtataattattatttccaatatacagatgagaaaatgaaggcacggagaagttaagtaccttgttcagatcacagccaggaaacagagaaatggggattggaagtcaggcagtcttactccagagtctgtgctcttgagacaaggttggcaaatgtgttctgtaaaggcccccatagtaaatatgtgtaggccataccatctctgctgcaactactcatctctgctgttgtggaataaaagcagccatagacaatatgtaagtgaaaagccgtgtttcagtgaaacgtattcacaaacataggcagccaatccctgttcttgagacagcatgctgtacagggggacaaacctcagactggctgggccctgaccccctattcttccttctaccactcaccttcctctaccaccaatagtaatagcaacagccacagcatttgtagaatgccggcttgagatggtcatacatgataatcatatgtcagggtaggattaagggaccatgatttatctcaccacccattagcaggtatgatggttaatttcaggcatcaactggaagaacgcttctggatgagatgaacgtttacattgaggaaagaggattgttcgtcatattgtggctgggcctcatctaatcagttgaaggcctgaatagagcaaaagtctgggcctctacaagcaagaaagaattctccagcaggccgcctgcaacttcacctgtaccatcctctcctgaatcccccacctgccagcccacagatttggactcagccgcctccatcatcatgcgagtcaatggctcatcataaatttccttccgtatgtatgcgtatcctattggtctggttctctggagagccctaatacagcaggtaaggtcgtagctagatggttgaggatacaaaactgcttgggagtggggaaaagggtgacaagtgctagaaacacatagctgagcaccagcaaagaagttggatgactccagatgtcctctccctggtttccctaaggtttggctcaggtcactgcagtcatctctccatggagcagtctatcaccccagaccactgctgggctgaagcaagcccaggacagcatttgctgtctgactggccctgggtccctggtttgttccatccaaaggggtatggatgatagggtagtataaatgcctcctgttgccataatctcttccttcatacgcatttttaaaaactatttaaaaaagaaaaagaaaagtaaagagaatccactccctggcctttttcagttttacctttttttttccttttttttttctttttgagacagtgtctcactctattatgcaggctggagttttttttttttctttttctttttctttttgagacaaaacctcactctattacgcaggctggagtgcagtggcatgatcttggctcactgcaacgtccacctcgggcttaagcaatactcctgtctccacctcccgagtagctgggaccataggtgtgtgtaccaccacgtccagctaattttttttagagacagggttttcctatgtggcccaggctggtctcaatttcctatgctcaagtgatccacccatctcagcctccccaagtgctgagattacaggcatgagccaccgtgcccggcccctccacacaccttttaaagtagtatttctaaagccagcttgtctgtagttgctgcattccattactccacacttacaggcaaaataccccaaaatggcctgtaatcccaacagtttgggaggctgaggcaggcggatcacttgaggtcaggagttggagaccagcctggccaacatggttaaaccctgtctctaccaaacatacaaaaattagcgggatatggtggcacatgcctgtaatcccagctacttgggaggctgaggcaggagaatcgcttgaacacgggaggtggaggtttcagtgacctgagatcatgccattgcactccagcctgggcgacagagtggaactccgtctcaaaaacaagcaaacaaacaaaaaacaaaaatagagaaagaagaaagatgccagggagagagataagaaagagagagaccaggggaaagttgaagacagacctgagatggggagataaaaaaaaaaaaaagaaaagaaaagggaagagaaccagagctaaggaaaggagaaagggaataaaaaacagaaagcaggaacaccagagagattcataaagagagacagagagagaaagggagaggaaaggaggcaagggaacaagagacacagagaggacatgaaaggtagggagagaagcctgcagagaatcacaaaaaaaagaaaagaaaagaaagaagaatcagaggatagagacaaagatgagagaatgaacaacctactcaaacaacaaaggcttttgagtacctctaggatttctcaacttcagcctattgatatttagagctggatacttttgttgtttttttttttagacagaattttgccctgttgctcaggctggagtgcagtggtgcgatctcagctcactgcaacctctgctgcctcctggattcaagcaattctcatgcctcagcttcctgggtagctgggattacaggtgcataccatcacactcggctaatttttgtgtttttagtagagacaaggttttgccatgttggtcaggctggtctccaaatcctcacctcaagtgatctgcccgtcttgacctcccaaagtgctaagattaggatcatgagccactgcgcccagcctggatactttttttgcgctggggactgtccaatgtcttgaagggtgtttagcaacatctctggcctctacccactagatgcctgtagcaccacctcccacagttgtgacaaccaaaaatgtcttcagatattttgtaaatgtcccctgtggcaaaatcaccctttgttgagagccactgagttaaagggatgcaatttttcatgcttttcagagcttaaattatatataaccaagggaatgatgggcccatggcagacagagaatacttaaagcccattttcctggagcactaattgtccttgatggtattttaaagcattatttttacatgaaaacaaatgtgggtatattacagagtagaatctcaaatttaaggcttggaagaaattttatgtctgaggtggggtgattttggctatactcccagaatccttggcaggtacacatttacatttctctgccttggaggaagctaataatagctaccatttattgagtgcttacaggggccaggagctttagaaattatttcccatttgatcctcactgggtgtttattattaatcccattttacagatgaggagactgaggcccagggaggtcgtgaaaccccattcaagtactgacagtgactaaatgatggagctcgcattggaatcaaacaaagtctgtctcactaagtatctgccaaaaagcttatgggaaggaaaaggtgaacagtgataaaccaccaaagtcaatatcctagtgctaatcaacaggatggcttaagaaaaagaaaggctctgttgaaactggcaaactcttaacttgtcttgggtggagagggagaaaaggggataggggttgaaaatgaagggattcccgaggtaggcaccacccctcaagtaggaaatagttaatcaacttgacagcatcaacttgaaactccaggctgggcatgctggctcataacctctaatcccaactttttgggaggcataggtgggaggatcgcttgaggccaggagtttgagaccagccttgacacaaagtaagaccctgcctcgacaaaaagttaaaaaattagccgggtgtggtggctcccacctgtagtcccagctacttggggagctaacgcaggaagatcacttgtggccaggagttcgcggatacagtgagctatggttggaccactgctctccagcctgagcagcagagcaagaccatgtctcaaaaaacaaacaaacaaagaaaacaaaacaaaacaaaacacctaaatcttagcctgagatccctcatgcaatccccagctgggacatccctcaggaagtttcttttcttattttattttatttatattttttatttatttatttatttattttattttattttattttttttattgatcattcttgggtgtttctcacagagggggatttggcagggtcataggacaatagtggagggaaggtcagcagataaacaagtgaacaaaggtctctggttttcctaggcagaggaacctacggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgattcagagagcacagggttgggggtaaggtcacagatcaacaggatcccaaggccgaagaatttttcttagtacagaacaaaatgtaaagtttcccatgtctacttctttctacacagacacggcaaccatccgatttctcaatcttttcctcacctttcccccctttctattccacaaaaccgccattgtcatcgtggcccgttctcaatgagctgttgggtacacctcccagacggggtggcggctgggcagaggggctcctcacttcccagtaggggcggccgggcagaggcgcccctcacctcccggatggggcggctggccgggtggggggctgacccccccacctgcctcccggtcggggcggctggccgggtgggggggctcctcacttcccagtaggggcggctgggcagaggcgcccctcacctcccggacggggcggctggccgggcggggggctgacccccccacctccctcccggactgggcggctggccgggcggggggttgaccccccccacctccttccctgacggggtggctggccgggcagaggggctcctcacttcccagtaggggcggctgggcagaggcgcccctcacctcccggacggggcggctggccgggcaggggactgacccccacctccctcccagacggggtggcttccgggcggagacgctcctcacttcccagacggggcggctgccaggcggaggggctcctcacttctcagatggggcggttgccaggcggagggtctcctcacctcccagacggggtcttggctgggcagaggcactcctcacatcccagacggggcggcggggcagaggcgctccccacatctcagacgatgggcggccaggcagagacgctcctcacttcctagatgggatggcggctgggcagagacgctcctcacttcctagatgggatggcggccgggcagagacgctcctcacttcctagatgggatggcggctgggcagagacgctcctcactttccagactgggcagccaggcagaggggctcctcacgtcccagacgatgggtggccaggcagagacgctcctcacttcccagacggggtggcggccgggcagaggctgcactctcggcactttgggaggccaaggcaggtggctgggaggtggaggttgtagcaagccgagatcacgccactgcactccagcctgggcaccattgagcactgagtgaaccagactccgtctgcaatcccggcacctcgggaggccgaggctggcggatcactcgcggttaggagctggagaccagcccagccaacacagcgaagccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggagagggagaggagggagggggagagggagagggagaggtagagggagagctatattttttattatactttaagttttacggtacatgtgcacaatgtgcaggtttgttacatatgtatacatgtgccatgttggtgtgctgtacccattaactcgtcatttactttaggtatatctcctaatgctatccctcccccctccccccaccccacaacaggccccggtgtgtgatgtcccctttcctgtgtccaagtgttctcattgtttagttcccacctatgagtgagaacatgcggtgtttggttttttgtccttgcaaggaattttctcttcagcctctgacctatggattcctcgtttcagcagtgcctatggctgcagtatctccccacctcccatcatcgtaggaccatcgacccaggctgtcacatccatggactgctctctctgatttgctcactacttttgctgctttaatgaactcagtcttttacaaaacatatttatttaaacgaaaaggttgcttttccttaccctgaccagatcactagaaaaataaatgcagccatgcacagtggctcacgcctgtaatcccagcactttgggaggccgagggggggtggatcatttgaggtcagaaattcaagaccagactggccaacatggtgaaaccccatctctactaaaaatacaaaaattacccgggcatggtggcgcatgcctgtaatcccagctacttgggaggctaaggcaagagagtcgcttgaaccctggaagcagaggttgcagtgagctgacatcatgtcacttcactccagcctagcaagagaggagactccgtctcaataaataaataaaagggaaactttatatcagtatctgaaatgaaaagtctgcttttccataccctgactagatcactagaaaaataaatgcagctgggcacagtgactcacacctgcaatcccagcactttggaaggccgaggcgggtggatcacttgaggtcaggagttcgagagcagcctgacaacatggcaaaactctgtctctactaaaaacacgaaaattagctgggcatggtggtgggcacctgtagtcagctactcaggaggctgaggcaggagaatcactagaacccgggagcccaaggctgcagtgagcagagatcgtgccattgcactccagcctgggcaacaaaggcagactctatctccaaaaaaaaaaaaaaaaaaaaaaaaagaaagaaagaaagaaaaaaatgcaataaaaataaacaaggctaaaacaacaacaacaaaaacaaacaaccaaggctattaaatttagttagttagctagacagctgtctttgttcaaaggggagacttgttagctttggagaagtgttaaaagtccttagcaccgagccaagatgttcttggtgcagtcagagtaactgaaagaggtttgaaaagggaatcactttatctggatataagtcatcgctgttagtgtcaggttatacctggcgccatcatgcttcaacgatggtatgtgtctcatacctgaggaaataccggtatggggctcgttatgggttgaattgtgtttcccagaaagtcataccttcaagtccttgcctaattgagggttctcagtatctcagatcatgactgtatttggagagatgacgttcaaagaggtaattaggttaaaatgcggccattagggtgggtcttcagtcttcattcagtccaactggtgtccttctaagcagaaatgtggacatgcgccagcagggacacacacagaggaaaagcatgtgagaacatggtgagaagggggccaactgcaagctaggaagagaggcctcgggtgaaaccaaccctgctctcaccaccatcttggacttttagcctccaaaactgtgagaaagtcaatttccattgtttaagtctgtggaagttatggaagccctagtcaactaatacaggggttccctgagcccccacatgcattccaacagaggcaggagaatagggtttggagaccaggaacataaggacttcctagaactaaatcaaatggaaacacttcagctgtgatgggaaatatcttctccatttacacagggcgtaagccaaataaatgactttgtaagtttcctccatcctcttcatttacataaggcatacaccaagtaaccaatggaaattttggggggtatttaagcctccaaaaattctgtaatggggctcttgagttcctgtgctctggcccacccccactctgtggagtgtactttagtcttcgataaattctgcttttgttgcttcattctttccttgctttgtttgtgcatttcatccaattatttgatcaagacaccaagaacctggacactctccactggtaacacaaccatctggatttgagtcctgcctctgctacttccgagttgtgagacgctgagcaagttactctacctgtctaagcctaggtttccttatctctaagttaacattccagtctgcattctgtgtgaaagttggtcttagaattgggtcgttcttgttacagccaactaaaacagagtcaagaggccaggaggaggaaaaagcagtcagaccacattacatggcttccagaaagtaattcttggaaagcctggctgctggaactgcctgctggaacctgaagccagttttatctaacagctactggaaaaacctgctgtgaccttaagacaagttttgcccactgccatcactcaccaaacagagtttgccagctcccacagccttacccttgccgatgaactttctcaaaaaacaatatgtaacatttctccttttctaaaatgcctctaaacttctctttgttctttggatgtactaaagaccacctggtctgcatatatgctctgaattgcaatcctttcctcccaaataaaacattttaattttagagattcatctaatatttgacttccacatatgaaattgttaacaatatacacaacatatccaaggtggttaacaaagtttctggcacagagtagggctcaaaacaacaacaagaccgggcatggtggctcacacctgtaatcctagcactttgggaggccaaggtgggtggatcactcgagaccagcctggccaacatagcaaaaccccgtctctactaaaagtacaaaaattagtgggctgtggtggtgggcgcctgtaatcccagttacttggaaggctgaggcaggagaactgcttgaacccaggaggtggaggatgagtgagcagagattgcagtactgcactccagcctgagtgacagagcgagaccctgtctcaaaaacaaacaacaaacaacaacaacaaactactatgataacaaatgttggcatacttcctggcccctgtaggtttgaagatggttttatctccaacaaggtaagaggtaaggatcttggtacagtatcttggatgctgtacttggtactagggactaagggctccatcttcaacactaaccaactatggaggcacatagcaaacaaaataatcaaagctctagcttcttcaccaaagtaacccagatattttaaaaccacccagcttgtgtctcctgtactctttccccatttattcctctctcatcaggactggcctgtttcactgtccccttggaaagcttttcagcaactttttgaccctccgtttaacacctctacctctcagactcctaaagcatcttacccaggtctcactgcctgtaaatccgcaaagccaggctttgaacccaggcttctgtgattcatcacacatcccacaagtgacagagagatgcagagagctttcatttgccaataataataattagtcacccattacatataatttataatcattaattatagtgattcatataatgattaagtataatgtgaagttcttgccttccacactaagggtggttatggcttcagttagtggaacacttgctctgcgcctgccgttcccatgtgtcatcccatggattcctctcaccacttctttacagaaattattttataactcccatttgatacacaaggacactgaaatgtagggagccccatgtcaccaccagcacatccactgcttaagagactctgggagagatcagagggtagacagggaaaagatgaagatgatgttagaaggcagcaggggaccagacacggtggctcatgcctagaattccagcactttgggaggccgaggcaggcagatcacttgagcccaggagtttgagaccagcctggccaatatggtgaaaccctggttgtctctactaaaaacacaaaaattaggtgggtgtggtggcgtgtacctgtagtcccagctaccagggagactgaggcaggagaatacttgaacttgggaggtagatgttgcagtgaactgagattgtaccactgcactccagcctgggcaacagagcgagactctgtctcaaaaaaaaagaaaacaaacaaaaaaaaagaaaacaaaacaagaaagaaggcaggagagggaatgttttcctcacctcctcttgagtctcctcagcagggctatggcctccagatttctctgctttaggagagtcagctaatcctccaccctggagggaggacagttcataaggatcacttagtcttctcctgatctaatccagctgggttagtttgctacaactgctgtaacaaagtcccacaagctgggtggcttatgcaacagaaattcattatctcacagttctggagaccagatgtccaaatcaaggcatcagcaggattggtctcctctgagggctataagggaagaatctatttccaggcttctctcctcatcatgtagattgctgttttagtctgtttgggctgctataaccaaatactgtagcctggatagcttataaacaaagcaattatttcttgtggttctggaggcggagaagtccaagattgagccatgggcagattcattgtctaatgagggcttgcttcctggcttgaagacagccaccttcttgctgtgtctttggacatggcctttccttcatgggtgcttgtggagggaaagaaatacctctctcccttgtcctcttcgtataacggcacgaatcccatcatgagggattcactttcatgacctcatctaaacctaattatctcaaagacctcaccttctaataccatcaaactggggatgcaggcatccaactgtgtccacatctgaatttgtgggaggaggcacaaacattcagctcataacaatggccatattctccttgtctcttcacactgtcttccctctctgcaagtctgtttctgttcagatttcccctttttataaggacaccagtcttattggtttaggttccaccctgatgaccttgctttaacttgattacctctttaaagacctgtctgcaaataaggacacattctgaggtgccaggggttagaactttatataaatttgaacacagttcaacctgtaacaccagtcacatgggcatgcatctcaagtttaatgatttttcctaatagtccagctccacctgcatctgacatctttctccaacaggaaaatattcctcaatcaaacacaacccttctcctgttacagtttaagctaatcttccattctcctgaaataataatatcccctgcctttatttatttattttgaaccttaagtttttgactctcctcatagcagaacaaccactcctcctcctccaattaaagtatacaaagtaaggaaattgagaagataaatggggaggggaggatatccacatcattctttttagttcagaatgagagccagttgctgtcaaggactggaaaaggaaggtatgctcatggttgtggttcagaagcctgagagctttggtttaaaaataggtgaactgaaataaacacagagctactcagatggcactgaaatagagtggtaattgatctaatgcaacttttgcctcggataacatcattatttgtgaaattatgtcagtgttgctactgccaagtcagcaagcacttacaggacgtgacttctaatttaggaattggactatttgtggcacatcttagaagacagcaggaactcagtggacacccggtagccagccttctgagagccttggtttgagcttgaaattcacaacgttgaagtgcccaggagtgccctgtcttgatgacccttcaaggaaaagacttgctgcccagctctagaaaatgtggtttgcaggtggctgtcggctgtcagttccttcatggtctttctcagctgcaaagatttgctgccccaggtcacgcctttcttggggcaacctcagcctgtgacttagtgaaacaggggtataaactaaggcctgggtactttggccccacttgggtcattctgatataatccagtacttgctccagagctccctgccaggtttcacgaggtttttcctgttataaaatacagttacagtctctctttccccagattttctgtctttttctagaaaggaggcaacaacaccttacatgacttacttattcccaaactgctttatccttttttcctaggtattattcccaaataaacacttgtacccagattctaattcaatgtcttccagaggacccaatctgggacagatgtctaggtagtttacaaagtcactgcacacttcctttctacctgtcatgctcctgaaagacagggggtgacattgtctcttcatgccctcattgagctggctgtagaattcttttgtggaatttcaagtggaagaatattttacattatttaagaatataataccagattttcatttatttcaccttcatgaaatgaggtacatgtgtaaaaattatggttagaaagaacagctcttttatttatttatttatttattttatttatttatttatttatttatttatttgagatggagtctcgctctgttgccaggctgcagtgcagtggtgcgatcttggctcactgcaacctctgcctcctgggttcaagtgattctcctgcctcagcctcccaagtagctgggactacaggcacctgccaccacacccggctaatttttgtatttttagtagagatggggtttcaccatgttggccaggatggtctcaatctcttgacctcgtgatccacctcctcggcctcccaaagtgctaggattacgggtgtgagctaccacgcctggcctcagccatttctttattcactttttttttgcccaattgcagtgtcccagacactgttcaaggtattgtgaatattatgatgaaggagacaaagattctcagagcttacattttatgggagcagactgacaatacacaagtaaataaatacattggtgaggaagtacagatgtaactgtagtaggttcattggctgatgcatgcaacaagtcaatatgctgagacactgggttgccgcagagaaagaggtttaatcatagggtcactgaatgaggagatgggaggaaaccttaaatccatttccctgagaagtttgggcttagggtttttaagggttttggagtgggctgatgtgtggagatcactgattagtggaaaagtgcaggatgaagtcatggtacaaggagatgaagaagctgtattctggccgagcatggtggctcatggctgtaatcccagcactgtgaggggtggaggcaggtggatcctttgagcccaggaggtccaggctgcagtgagctgtgatggcaccactgcaccccagcctgggcaacagagggagaccctgtttcaaaaaagcaaaacagaaaaggagccatattcccttgctgatccctttcctctgtggggggtcttctaacaagttgctggaattcagggtctgaaaaacatctttaaccaaagccttatgattctaatgtcagagatcttatctatatgaatgaaggggatgcaaatctattctttttttttttttttttttttttttttttgagacggagtctcgctctgtcgcccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgcaaatctattcttaaacaatctcatgacgctaatgtcagaaatccctctgtaggaacaatgggaatgcaaatggttagtatccagtgctacatgacttttaacaaaaacaaattgagtcaaagtccagcctgattaatgcttaattatagctacatttatgtacagaacctggcatgcaatgcttgtcaaccctggggggacagtttcagatactaaaacccgtgaagaaaataaagtagagaggatagtagctgttgactggggtatgcgaagattcgtttgatcaaatggttaggagagacgtttggagaaggtgacagtagtgttgaaacctgacaaagaagatccagccttctgcagatacaatgttacctgttggaatcgaaaagacccgcaagttctagtcaaagttgaattgaaccaatggcatcatctaatggatggagataacaacttgttcaggcatgtttggagtacctgctgtcacgccaagctctgtgcagggccatggaaacctagctaagccaggaacatccaagagtctgagccattcacaggctaaagacagagcagagtggagcacctcaccccggcaccttgacttaaaccgtgtggttcatgcatctgttcagagctgtcgatcaaaaaatgttcagagttctctgtccagatgagaccatttatgtctgtgtacccctagaggggagaggcaaaagcattagttattgtctctattttcccagacttcctgtctttttccaggtaggaggcaacaacctcttaaatgacttgcccgttggaaatgagtggtgttgctgaaggcccagctcaaattctcagactatgtatgtgtgcaaggaatgctcattacgccccatgagctggtatttccgagtcaagatacaatgcatctggatagctttttttttttttttttttttttgagacagggtcttgttcagttgcccaggctggagcacagtgactcaatcatagctcactgcagcctagaatgccagactcccgagtagctgggactacaggcacacaaccaccatgcttggctaatttaaaaaaatttttttttttacagacagggtcttgctatgttgcacaggctggtctcaaattcctgggctcaaattatcctctcattttggccttccaaagtgctgggattaaggtgtgagccactgcacccagctggtgtgacatttcctatccagccacatatctcatcctatttattcactcctcataccttcatcctttgcacctgctgttccctctctgtggtgcctctgtttacctgatgtactcttcatcattcataatctggattaagtgccccttcttctgtatatgcccccacccccaaaacacaaagagcattgatcactctcacctctaacctgtgctacagatggtacctcatgcgcctccttttctctcaaatggagatattgataatacttacctcctatggttgatctaagagttaaatgatatatatcaagattttggacccacacctggtcaactgtaagcacttaagaaatgtatgccaatagaattacatctctcagtcttggtgcttgaaatacttactaataatatctaacacttactgatcagttattatgtgtagccactgtgcttcattttaacatggatttgtaaaaaggcaacccttagcaaacctgatgaagtaggtactattactatcactatattaaaattgagaagccaggtgcagtggctcacatccgtaatcccagcacttcggaaggctgaggcaggtggtttgcttgaggccaagagtttgagacaagcctcgccaacatggcaaaaccccgtctctactaaaaatatgaaaattagccaggcatggtggtgggcgcctgtaatcccagctactcgggaggctgaggcaggagaatcacttgaacctgggaggcagaggttgcagtgagccgagatcgcaccattgctctcctgtctgcgcgacacagcaagactccgtctcaaaaaaaaaaaaaaaaaaaaaaaaaaaaattgagaaaactgcagtatgcagtgtttacagatgtttccatctttttcttctctgttaggctgtcaccgtttcgagggaaaaactcacaattcatttaactctctacctccagttgttagcatagcgtttttgggtcaataaatatttggtaagtgagtgaaggaataaataaagtaatgaagcagagaaagtatcattgtttaggaggtgaagaaatgaggacgacccagggaagaaatagactgaggataaaggtgcagctttttccaatccagagtccacatggttctctattaaaccagggcttcccatacctggacatgcataggaatcacctgggaaccatgtgaaaatgctgattctgagccaggcacggtggctcatgcctatagtcccagcactgtgggaggctgagatgggcagatcacttgaggtcacgaggttgagaccagcctggccaacatggtgaaacctcgtctctactaaaaatacaaaaagtagctgggcatggtggtgcatgccgatagtcccagctacttgggaggctgaggcatgagaattgcttgaacccaggagccggaagttgcagtgagctgagatggactccagcctgagtgacagagtaagactctgcctccaaaaaaaaaaaaaaaaaaaaaaaagcagattctgatctagtagatctagggtgaaacccaagatactgcatttgtcataatctctcatgtgacacaattagtctgtgatcacaccttgagtagcaaagcactaagctacttgtgtcagttggttctatgcttgccaacatcagaggccaactcaggctcacttaagtaaaaaaaaaaaattgaacttactagggtatgcatggggaagcacccagaatccaaggagaagtacagaacccagccccagcaaggacaggaactaaagcactttgggttttgggtttttttttttttttttgactttatgaacatttattataattattttttatttacataggttattggggaacaggtggtatttggttacatgagtaagtttagtggtggtttgtgagatttttgtgcacccatcacccaagcagtatacactgcacccaatttgtagtcttttatccctcaccctcttcccaccctttccccaagtccccgaagtccactgtgtcattcttataccgttgcatcctcatagcttagctcctacttatgagggagaacatacgatgtttggttttccattcctgagttacttcacttagaataatagtctccaatctcatctaggttgctgcaaatgccattaattcatttatttttacggctgagcagtaaggaattaaagcactttgaacccaaacagggaggagggggtcccttgctgcgaatcccactgtcaggagaaatcagctccaactatgtactgcccttaaatcactccatccaaagtttacatttctgtgcgatggtatctaattgactcagtatgaatcacttaccatccaaggcaaaggaagggcagaatgttttgattgacattctcattaagaccatgtgcaatgaagaatgggcattttcttggagaaaaatgttggggtttttatactaaaagaaaggagacattaagttaccctgcccaaagtcagagccaccagctctggggcagatttaaagatgaatgtgagacttttggacacccctccaccaccgaccccagccttcctgagatggtcagctggaccactgagcatccccagtgactttggcagagactgattctaaggttggatgggccacagagattgggctcagaatggaaactgatcatcaaagtgatccttaattctcgcattagatttttatccagacgtggtgagcaaagtggctggcctactcctctggtttatgtggtaggtcataggtggcacagtgcctgcttagcagggatttaaacaatcccttatcatcttctgggctttcttgtttgatttttttttttttaactttgttcaattctcagcaactcgattttaaaggtcattatattaactgcaaagatgaatcaagggatgaggtcatttctcatccagggaaacgctttagtcttggatgctgtcatcttcatgctccatagatgctgatctgggctttaaaaagacaattctatttcaacatagtattctttggggggaaaaagactgccttcctttccaaaactcagctttgccaactcatcaaaggaagcctttgtatccacatttgtgtccctcatatctgggacagcagctgcacactcaaaagtcctactccagctgaagggagtcgtggactttatcgtaatcaccttgttgaaatatgtggaattgtatagcaacagccaggttctatgttgccataatttatgacaaaggctcaaataaatccccagacatggattttctataaaatccttcattgtgaaagtttgttgcactgcaaaaatgaaaagaagacggaaagaagagaaaggaggaaatgaaaaagtccgcaagacgtatataaacctctgaggatgccgtttccattcatcacctttactgtaaagacagggattttatttggatggaaaaggaatgaatcatagggttttagaatctaatgcgaagtttgctggaagcattttcctctgatctttctgcttcctcaagatcatctgaatatggagagagaatgagtgcaaagaattctatcagccatagaaggttctgtgctgggatgggtatcagaggatggagagagatctctttttttgtgacttttacctgggacgttcattggcctgtgaaggtttagggatacaatatagtgacatcagaagcatgtgttagtgatttaaattatacaatatgaggtgagcagatgcaagaacaagagaaagagagagtggggagagagggaggggatgaagatggagaaggaggcaggggaaggtgaggacgaaagtttccaatcatatagtttatttcatccaccctcccactcatagcctgagaaaatctgattctagagatcccttcctttgctcttttgtccctcatactatgagcatctactcttgctaggtgccagacagctgtttttattcagtatgatcccttaaacacaaatcaacctcttcatcagatgctcttcccaaaacacagtggtttgttcaagatagacggaaaatggactgtgttggacacattgagagactatctgcttcttcaaagcatgggtgacttaagaggacttttaaggaaaattctgactatgcgattgtttctttatgtgatacctctagaatctaattgcctcttaaagttactctctactggggtcccttctgagcagttaggggatgaaggttatggttaggtctaaatttattcattcattattcaccagatacacacggagaacctcctttgtgccaggcatagtgctgagctagggcgagattacatggtgcttcaaagagaagtttctcactgatctttgcatgcaatcacaaagtttaaagctggaagaaccctcagaggatatcatttatcaagaacaatgttgagcaaccttttatatgcaagcactgctttggggaaaataaacatgttttactcgccacattcttttggctcattcatagtgaaaacagttttattgagttccttggctgggagggaggacattctcaaaacccagctcccctatttgatggaatagaaggccattgattaaaaacttagcattgcttgtgggccactaaaatgcaaatattggggtatctttgggaagtagttccatggaggtagttttcagattgttcaatctaaaattaggtggtggtctgtgtcccaaagtttaggcagaacacacgtggctcccaggctgctggtgttcatggtggaggtagtgagtgggaagctgtgcttggtttcattctagatcctctacagcacagtacaaaataatccttttctggcttaggtatctgttttatttagagcccttgtggttgcaaactctgaaagaaaaataaaattgaaggtacaaagtctcacaagaattcaaaagctgaggtgttagcattaggcatggcagaattcagatgtttaagccatgtcattggtaccctacttttccatttactccattctgctttcctctctggtggcttcactcccaagccaggtgtgctctgtgtgtgtgcatccaccacccagccagcagagccaggcttacaccctcccaaatttaagtccagtaggaaagagttgcttccctctaggccatgcttgctccagatttggaattagagctgatgggctctgcctaaccatgaatccatctcaatggtctgattggccacgatgggtccactggtcaaggatagggccagactaatgtaagacatatggatagagagtgaggcttactgaatgaagccaggtgatcctgaaaatgcaaagactcttcatcatcttttctatctggccattcatccatctgtgtgttcgtccatccatctgtgtgtttgtccatccatccatcccctgacctatctacctatctatccattcatccaatcatccatccatacattcacctatctagatatctatccatccacccaaccacctagccactcagataactagctagctagtgactgcccctttgttgtagaaagcaattatatgttcagagcatggcatatcttaggagttctaaaactcctttgttaaaagtaaatgaataaatgaatttagccttattctcaatttatacacattgtgaaaaggtgaatcacaacagctaatgccagagctggactctgcacccagtccccacaactaaaggtttctcaggaagatgttgcttcaacaggtggggaataggagattgctggcaaggcagatgtatgtgaattattgcctaaatgcaatggcattttatgcaagggtatacttatctgtggtttcattaaccagtattcattttcatctcagtatcatatctatcttttcaggaaataagtttactttcactataaagctacatctcagaaatgaatgcaaataacaattttaatgtcaaagccaggtccattttttatggctctgtgccctaatccataaagttattacccaaactattgaaatatgccccaaggatcggcgtcttaataaggctttagaaattaccacaatatttgtggagagaatggggatgcagggcgtctgaaacagttgccatgaaaaatgcttaagtagaggtcaacaaagtttgaaggtgtgggaatgggcgggggagtggtcaaacgtgtcttcacctccatctttagtaatttctacatatatgtgatttttttgggtcacgtatagctgttttttgtttgttttttgttttgtttgttttttgttttgtttttgtttttgtttttgagagggagtctcgctctgttgcccaggctggagtgcagtggcgcaatctcagctcactgaaagctctgcctcccgggttcacgccattctcctgcctcagcctcccgattagctgagactataggcgccaagtttagatgtcttataagcccaagactatatgataaatgccttatttgaattatagctgtgttattgtagtgttttgtgcccaccagttctaagatgtaggttcagcctaaaatttctgattgactatttccttacattgtaaaataatgggagttgggactcttgggttcattcatttgctcaacaaatattaattaagcatatactatgtgccaggcactgctctgagatacaacagtgagcaaaccagataccaatcttctcccttatgaagcttagacagtgcagtgccaggttctgccatgaaggaacggttagtgctttgcatgccatttgccttctgtgggcatctgttttcctgtttgtaatataagaggcaaggggactcaacaccaaccaaacgaaaggaacaacttaaaaaactaagcttggcaaaaggaaaagttacacaggacaggtaacctatgtgcaaacactgagaaaggtgtttggtttaagagcaaggatactacttgacactagttgatctgtgtggctcccaaagacaggatgaggactgctagacactgagatcaaccatgtataagatgctgaggagggccgggcacggtggctcacgcctgtaatcccagcactttgcgaggcagaggcaggcggatcacttgaggtcaggagtttgaaaccagcctggccaacatggtgaacccccgtctctcctaaaaaatacaaaaattagccaggtttggtggcacacacctgtaatcctagctactggggaggctgaggcatgagaattgcttgaacccgggaggcggacgttgcagtgagccgagatcgtgccactgcactccagccagggaaacaaagcgagaccctgtctcaaaaaaataaatttaaacaaaaataaataaataaaaattaaaaatttaaaaataagacgctgaggaggtggcaagtttcttatcactaagagtgtgcaagaagaggctggaagagaacttggcaggatattggagaagatgcaagtatcagccttctaaaaactctttaacatatgagtgcaattaacattactatcttccatctcagtactgcaccatgacgaccttgtggcctgcatgtttgtggcaataggataagagaaagaagggggagacctcttaactaccttggccagaaagtgacacctatcatttctgcttacagtccattcaccagaatgagtctcatggccccagactaatatccaggaaggccaggaaacataagtgagaacatgaatataaggtaagcaccatctctaagattttgaaaatatggagagacataataacacctatttcagagagttacttttagaattaaataagctaatccattgtgtcatctagtaacttttcttttttttaaacgagcctttctttcatcctcttcctcttttatttgacttcaaagatcaccatattatctggctggacccattgaaaagatgctctatggagcccctaggagaagtcactgatgaaagggattgatcttatatggacatatccccacacactgatgcctaaaattccaccattagaggcaccttcctgccacgtttcacgtctctaggcttggggtaggcaagggatgtggagggtggacatggaaattccaggtgggaagctgtcagtgacaatttcagccaggctggccctaaggaggatggaggttgcatagctcagaaacccaccacccacgggttgctgttatatatgcagttagaaaggctgtttccccccagtggagcaacctaggggcaggctgtccatctgaatctgaaatgaattcaatttagcttcatgtaattgcttatttgattcctgacgatgacatgcagttaggaggtaaattgacattctgtcatttctgttccaatgaactgaactccaacaagttccctcctaggtactttgtggcagccaggccacctgctcttcttctgaagagaaattagcgagcacagggagcttggaaatacagcatcccgagcctggtgcctttttttgttgttgttacggttgtgagatgaatcacatagtcagacaggggtacgcctgaacttccttttcccctggtgaacacaatagacgtcctttcagaaagctctcaggatgactttctgctttagaaacatgaattttctcgcttgtcatccaaagtttatttctgttcaaggtcaattttgcaaaaaaaaatcaaacaatataggagtccgttttgaaaaaagatttcaaacaatttaggagacatctccagcaagtcataaaagacctcacccgttccaagcacaggaataggtgtttgttttgtcgtggctacccagtgccctctttggccaagcctttatataaccacagcattctgaatggtgcccacaaggctatgggaaaaggcagtcccttcaaacaaaggggaggccagccaggcagacaggacagggctcgacaggatgctcagaatgtgattgaagggtgagcaagaaccttgaattttattgattaaagacacaaattctcaagggcataaatagagggcccagatgtcaatatccacagacaccaagccttctgtgtatactggacagatgtcatttacatgatcatggtaagaagaatatggtattgtaagtgatatggtaagaaacaatatgaatattaaaccatgcagcagtgcttctcaacaggggcaatttggcaatacaaagacatttctgaggctgggagcagtggctcacgcctataatcccagcaatttgggaggccgaggcaggcggatcacaaggtcaagagattgagaccatcctggccaacatggtgaaaccccgtctctactaaaaataccaaaaaaattaggtgggcgtggtggcgtgcgcctgtagtctcagttacttgggaggctgacgcaggagaattgcttgaacccgggaggtggaggttgcagtgagctgagatcgtgccactgcactccaccctggagacagagtgagactttgcctcacaaagaaaaaaacaacaacatttttggttgtcacagtgagagggatactactggcatttaatgcgcgcaggccagggacgccgctaagcctcctgcagcgcacaggatggcttgccacatgatggaatgaacaggtccagactgtcaatagtgctgagcttgaaaaacctggtagagagcaaggggccaagcacgtgacagtgtccacttaggagaagtgatgtcggctgtgttaggaaagacagtttccgctggacttgggggaaagttcatgctgagttgagaaaggtgaaatattctcatttagaatcacaaatgtgatcacatttcttctctgtttaaaataattccacactgtatgaaaaaatcaggccaagcacagtggctcacatctgtgatcccagcaattttggaggccgagatgggaggattgcttgaggccaggagttcaaggtcagcctgggcaacacagtgagaccctatctctacaaaaaaaaaaaaaaaaaaaaaaaattagccaggcatggtgttgcatgcctgtagtgccagctccttgggaggctgaggcagaaggatgggttgagcgcaggagtttgaggctgcagtgagctatgaatgtgccactgcactccagccttgggggcagaccgagacactgtctctaaacaaaacaaaacaaaaaaaaaaccataaaaacccacaacaccaccttgtaccctataaatatatgcacctataatttctcaatatataataaaaatgtataaaaaaagaaacatgtttttatttaacatttaaaaaccctgggtcaggcgcagtggctcacacctgtaatcccagcacttggggaggccgaggcggggggaccacttgagatcaggagtttgagaccagtctggccaacatggcgaaaccctgtctctactaaaaatacaaaaattggccgggcatggtggtgtgtgcctgtgatccctgctacttgggaggctgaggcaggagaattgcttgaacccaggaggcggaggttgcagtgagccgagatcacgcccctgcactccagccagggcaacaagagcgaaacttcttctcgaaataaaataaaataaaaatacaaacctgtattggttttctattgtttttaagaaaaagtccaatctgtataacacagtcgccaaggccctgtgtatatagttccctcatcttctgcaggaaggagaggaaaaccagaacttagggaagggacattggtctgagcaccctgccttcaatgtcaagttaatgagaaaggttagaaaagaacacttaaaaataatctgtcactgctatagttgcaaacaatggggaaaagaggaagtggtgagaaatgaatctgtcatgcagactccatgagggttattagcagattgatcctgaaagagcaagaaaggtctgatttgttggtaaaatactcagctataatgaaaacaaaaaagaggagaatcatgcagacatccttcctcctccatcctccatttacagtcaaagccttgtttcctccacagcagctcttaggactctgggaaagaaatggctgatgaagaaattttggagatttgactgctgagtccctagtctggtattgttaagagtcatccaggaaagacacatgtcacccctcctagctctgctctgggttttgtttctctctggcacaatgtcctatgaagactggactataggtggcctggtcttattcgggttacacaccgctccactctgctcactgggcccccactgcactagacttctctcaggaccttcagtatcacactgcagcttcccacaagttcttcccacagcttggattccagcctctgcccatgtgtctccccttctacatccacacaacccacattatttactcctgttcatctttctgattgttgcgcaaacattatttctagagagattttcctgatgctgcccaacctggctcagtttcctttatctatacagtcccatgccctccttatcatacttataaaatgacatattcagtaggcttgtgtatttttccaccttttgatggagctccatgagaatagggaccaaggctgcccttatatgcactgtgtgaagggatctagcaaaggggcagttggggcttaaaactagccttcgatttgctgacctggcaaggcttggctgtcatacaacctggggtatccccagcacctagcacagtgcctgactcagagcaggtccccaggaattgtggattgattgacactgtctggctaggtcccagcaccatccatcatgagacagaaaaaaaaaaatccgcttcccaggcagagcagcctccaaggcccacatggcccacggcacctcctcatcagcacgcacttcatgctggccagccatcagccaagctgcaatctcaataaatcaagaggctggggcaccatttcccagggacctgccagagtgcccctgggcgcccaatgaggctgagagttctgctgccggtcgtggatcttgaactctcaaaagcaattggtgaaaaacaccaatggattgtgaaagaagtgatcactcctcctttcctctgtaggtagaggttgacagtcaaatctagtttcaaggtctctgtctctttgcggtcctaggtaaatacgatcatctctcgaaactttcattcctccatctgtaaaataggtatgatactcatccctaccatccaatgtgtggagatccacataatgctctaatatactaggttggtgtgaaagtaattgcatttttttctcataaaagtggcaaaactgcaattacttttgtgccaacctaatagtacacggcacagtatatacaatgtgtaatatagtacatagtacatagcagattatatatataaattatatatatacatataaaaataaacatacacacacacagacacacacacgcacatatatataatgaagcctcttcctttaatggcccaagattgagccaaaaggaaatacagggaattaaaccatgaggacagaaatctccatctaggctgtcttggttgttctgctcacattcccctacccaggcttgcaacctcccgtgaggctgtctgagcctggacacacccctagaatcttcattgccaacaaaagaagagaaagggaataaggggtatttgtgtggaatctgaaagagacaaacacactccttgttcttctcaatacaggtgtttccaaagctgccagagagacccagagcttagagttgtgatgacacaagggtaggtgatgtggacaatgaccggggcccccagccaaaaccatccctgtttatctgttccacagaatggtgttcaacatcagttcttgtctggtggagggggaagagattgtgctaatgaataaacatacaaagtagacaaatgtttatcactccttactagcataagattccatgcgtacaaaaccatataagctgtctatatgtgtgagtacagctctagaaagacagaaatgattgtattggatgccagcttaaagttgggaaataccattagaagaaatcgcaacttgagaatcttgcattttattgccaagtgtttggttttaacgagagtctaaatgtgctcacccattcactcatccctcccataaatattccctgtggcccattatgagtttgacactctgctaggctctggaagacaggcagaatgatggaaagaatcattttctagaaatgactaaatcctagttaaaaaggggaaatatttaaactattagtgacaatataatttatgcattccgctagtacatgcggaacaactcctgcatttcaagaattattctagacacgagggatacagtagcaagcaaaatataaagatttctcttttcatggaacttgtgttctagcggggggaaagtgcccaataaaaaaataagcgaataaatgcataattcatactagctagtgataaatgcttttatagtaaagcaggtaaaagatgaagagtgatgagaaggggctactgttttagatcaagcagctgggaaaagtcatttggaagaggtgacatttgggcaaagagctgaatcaaatgaggcagtaagtcatagcaggtggaagggaggtgtattccaggcagaagggagcaagtgagcgacagccctgatgagcagggtacctggaatattccagaagcagtgggagaaatgagtgcggctgaagcccagggagcagtggagagatactggggagagtggtgaggccacatcatgtaacacagcctgcgttgctgagcagccttcaacaggatgcaagccctgacaacgaaagaatagttaactcagaaaaaaacaaaaccaaaactaaaacccagctgctacggtaatggaattgggcaagcaaaaccgatagttcatgaaacacaggagcaagacacctgagacctggctcacccagcaaggtggctgcagagctgcttagacttggagaagcaggggattccctgttatttccaactaataggaggagtcagagtgcagaatgaagatgtgctctgctagccacctctagagaacatctctcctcatttttgactgcccagaacctacctatgctgagggaatcctcctggtctctgttcccacctttctctgcagaagctgataccagttttcccagcttcccttgcagctagggtaaaagcacgtgacctcatttccaccaatcagcttgcttgctccagccttcaccatggaagctggcatttccctcaatggtggctttccctctggaggctctaggggagaattccttctttgcttcttcatctgctggtggctgctggcattccttgaattctggctgcatcactctcattgctacctgcatggtcaggcttccttctcttctctatgtcttctcttctgatggtattaagactctttctgtttcactttttaaaaaatctcatttttatttattttttaaaatatttacttttatttcaatagttttggggaaacgtgtagtgtttggttgcatggaaaagttctttagtggtgggctgggtgtggtggctcacgcctgtaatctcagcacttcgggaggctgaggtgggcagatcacttgaggggaagagttcaagaccagcctggccaacatggtgaaaccctatctctactaaaaatacaaaaaaaaaaaaaaaatatccaggcgtggttgcatgcacctgtaatcgcagctactcaggaggctgaggcactagaatcacttgaaacccaggaggcagaggttgcagtaagctgaaattgggccagtgcaccctagcctgggtgacagagcaagactctgtctccaaaaaaaaaaaaaagagagagagaaagagaaagaaaagttcttaagtagtgatttctgagatttttgtgcacctgagtagtgtaactgtaaccagtgtgtagtcttttatccctcacccccctccccatgtacccccaagtccccaaagtctactgtatcatttctatgcttttgcatcctcatagcttagctcccacttatgagtaagaacatacaatatttggttttccattcgcgagttacttcatttaaaataatggtctctaactccatccagattgtcgtgagtgccattattttgtccctctttatggctgagtagtattccacagtatctatatataccacattttctttatccacttgttggttgatgggcatttaggctggttttatatttttgcaattgtgaactgtgctgctataaacatgcatgtgcaagtgtctatttcatataatgacttctgcttcgctcttaggacacttgtcattggattcagggttcacgtggataatccagaatgatttcctcatctcagggcctttaaattatttccatctgtaaagaccccatttgccaaataaagccacatttacagatttcagggattaggacatggtcatatctttttggaggccaccgtcccatcccctatgccacctcctagagatcttatgaactaactaatacctttttttttttttttgagctggagtcttgctctgtcacccaggctggagtgcagtggtgtgatcttggctcactgcaacctcggcctcccaggttcaagtgattctcctgcctctgcctcccaagtatctaggactacaggcacctgccaccatgcccggctaagtttttgtatttttagtagagatggggtttcactgtgttagccaggatggtcttgatctcctgacttcatgatccacccgtctcggcctcccaaagtgctgggattataggcataagccaccgctcctggccactaataacttctaatactttttttttccttttcgttgataccagcctgaattggtttgttttttgtcaaacagaagcttgacatggaccccaccctatctctctattcctggccaccaaagaggacaagatgtctggaatgcagccctgcttgggggcataagtgtgagactttggttccagctgatatgcacaactctctgccttcccgtctgctcactttgactcctgcctcgtagtaaaggaacggacctcccatgtcagaagctctgtggttgagacattttctttcaggttaaaacatgtcttctggccctaagagattgggatgtgaaacccaccacaaagagtggagggaagctggctgggtggtcagcctcaccacatcaactatttatggctttgttaaaaaataaaaaccagagcaaactcacccatagaaacctacagaacatgcatgagcctttaggagacttcaggagggacagtgttgtctcctaagctgtcttgcaccagtggtgtcggtgcgtgggggtgagaaaggaaatctcacgggaaactttccatgaatacttggagcctattatgagcaagaaaacgacaatatgacaaacacaagaagcaatatctcacggtggttacacccatgtgcttcagagccagagagatatgggtagaagcctgaaaactgataccactgcttaccatctgtgtgattttgaggattttttaaaaacctgagcctcagtttcctcatctttgaagggtattaatgcctgccttgtttttttgtctgttttgtgaggattaaatagattcagtaaagctcttagcttagtattggtgtatgtgaatatgtgaagacatcttatattcctttgccactattgtcatccctcttatctaaatagcatcatcttgaattcagttaaatctgtggacgtattgtctcttagtgcatgtgctgtactccacagtgtctggcacgtgataggtgctacatgaatttttggtttataaagctgtattgttttgatgggtgtgtaatcagagtttaacggaccagaaggtgacaaaattcaactgatcctcctagacatggtgccatatttctctggctccattctaactataatgccagtaatttcaatctccacctaaataaagctcatcactatcactcccccaccatgtctgggagtccctaggacaatgtctcacctgttcttgcatttctggtttgtttgggcatcagtgacacctgccattctctttctgctctgcactgcccactatggatgaggataccataggtgaagggttatgagatgaggttgaatgactgtgatattccaaaaatttccagttgaatcaaatatcactgagctctgcgaccctggctggctaagtcacagaatctttttttactttttgtgtgtgtgtgatggagtctcactccattgcccaggctggagtgcagtggtgcaatctcggctcactgcaacctccgcctctggggttcaagtggttcttctgcctcagcctcctgagtagctgggattacaggtgcgtgccaccacgcctggctaatttttatatttttagtagagatggggtttcaccatgttggtcaggctggtctcaaacttctgacctcgtgagctgctgcccttggcctcccaaactgctgagattacaggcatgagccaccatgcccagccatcacacaatctttttaagtctgagttttatcatctgcaaaatgggggagatctatcttcctcatagggatgatgattaaatgaaataatgaacacaaaaggaatagcctggtatgcattaggtactaaataaatgccaactatcatttttatctccttgatgaattattttcctagtggctataccaccccacatgccaataatgacttttggtagatatgccatatctagtcagatatttgggggtggtgggagagtgagctggtggcagagaaggtggggacagagactttctattatggcatctcggaggaataaaatagtaactgtcagaaacgtgatgctatagaaatcagctacagaaccagctatatggattgtgaattttttttttttttttttttgagacagaatctcgctctgtctcgcaggctgaagtgcagtggggcaatctcggctcactgcaagctccacctcctgggttcacgccattctcctgcctcagcctcccgagtagctgggactacaggcacctgccaccacaccaggctaattttttgtgtttttagtagaggtggggtttcaccatgttagccaggatggtctcgatcccctgacttcgtgatccgcccgcctcggcctcccaaagtgctgggattacaggcatgagccaccacgcacagcctggattgtgaagttttaactccagtgctgtcatttgctagcaaatgcccttgggtaagttctttaatcttgcaatgtctcagtttttaaatctgcaaatagggataataatacctatttcacaggactgtaaggataattgaataagttcattcatgtcaagcactcaacatgacttctaacatgtaataattaatcaataaatattgactattattagtttcccagtgaatcaatcaagaacgtacgtttttaaaaaaatccttaagtgccactttgtggatagatctgcccttaccgtgtccaagggatctatgtgccttcaaatgttcgagtcacatttcacctagatgctcagatatgcagaaattctaaggataaaccacctaaactactgctatgtgtacagacctgtgtacaaagggctaacatattgagctgggctttcttctttattggaatgcacccatgtttgctgatgagaattttctacctgaaagggttcatgaaagtggaagattgtacagaccatttgtgaaattttgtgtccaccacccagacctgggaagttcaacaatgtaatggctcctgtcttgacatgtcatggaatggtcaaggaaatgaacgggtttctcaggggtgtttggttgtaagcccaagaaactgactcaaatcagtccaagctttattggaagtattcaagcgtacttcctggagcacacagacagatagtatagttgggctcacagggtctagaatcagaaactggacctattagggtccaaggcaactcttccctctctctgctctggtgctttcagctagttcgcttcgtttcttcctttgcagagtgaccttttctgcctctcttgcccacaacccaaagacccaaaggtggccaccccatttttatgtcctctcagtactagtgcccccaaaaaactggcaagaacaaccaagtccaactccaaattcccaggggaaatgattggccaggaaaagaggccaaaaacatgtggtgactcacgaagactcaatctatggaaggaccacttgacaaagatccaagtcagaatcctctggggcattcagctggccattggctatttcaggtcggtacactgtcttctgcttcttgatgtctaggtctcggggaaggaccacgtggcctgctggctcatggggctccatgtacccttctgcacttctccaaagggccagccttttttgctgcaccagaggctctgctcatacccttccctctactttgaacacttttccctgcaccctctcgtcctacacttttgcatacctagctcctcctcctccctcaggtctcatgttaatttcacctccatggagagactgctctccacgccctacatttgtaactttctctggcgctctacatcccctatatgttccctttatggaactaacacagtctgaattaaatgcttataatagtagctaacacccacatgatatttcctacgtgctggatattttcataagagctttgtacatgtgaatttttttaatccatcaacaaatggggcaggcatagtgactcacacctgtaatcccagcacttaagtgatcaagaggatcacttgagctcaggagatcgagaccagcctggccaacatagtgaaaccccttctctaccaaaaaatacgaaaaattagctgggtgtaatggtgcatgcctatggtcccagctactggggaggctgaggtggaagaatcacttgaacccggaggtggagatggcagtgagctgagatcgtgccactgccttccagcctgggtgacagagtgagaccctgtctcaaaaaaacaaaacaaaacaaagctatggaataggcattcttagtctctcttgttccacaaatgagaaaactggggcacagagaggctagctaacttgcccaagatcactctgcaaagggtctagttccgtagtctgcactgtaagcctctgctgcctcttgaccccaacaacattctacagcttatgggattgattagttattttatgtctgcctcttctactggagtttaggctctgtgtagtcagggactgcactgatcaggcccactgtgtatcttcattgcttatcggaatacctggcccttagaaaatatttgccagatgaatgaacacatgaaaataagaatatattaactggcttaaaaaagaacaacccagattcctgcctgaatgagaagagggagccaggtaagtctcccaggactttaagggggtgtatgtgggattcaagagaggaagcttttccaaaaatagcagcaggagaggactgggagaagagatccttctcatggaatagcttgctttctgctgttgctgctgctgctgtcatttctgtcctgtggtccccttccacccagtctcaggttgccaatctgagcttaatggacctgctttcatgccctgagaggtgggagcagctggcattaataaatggagagcacttcaagaaacaactgagtagaggctcctgagatgtcctgagcttaggcatgagacactgatggtggctccctcttgacctggattgtttgtggcaggaagaacaaagaggttgggggtggaggaaatgtggaggggtctcgggagggggttccacctccaaatgtatccagaatcctattctttctcattttctccacctctatcacctgggccccagccatgtgggactacaacggcctcctaactgctcccccaggtttcaagcacccccccaccactctgctatcttctcaactcagccaccagagccaccctgttagaacccagagacccccagttcatgttgcttctctgctcagagccctccagggcaccacggaattcaaggcaaaagccaaagtcctggctggatgcagtggctcacgcctgtaatcccagcactttaggaggctgaggtgggcggatcacaaggtcaggagattgagaccatcctggccaacatggtgaaaccccgtctctactaaaaatacaaaaattatctgggcatggtggcgcacctgtagtcacagctactcaggaggctgaggcaggagaatcgcttgaacccaggaggcagaggttgccatgagccaagatcgcaccaccgcactccagcctggcgatagagcgagactccatctaaaaaaaaaaaaaagaaagaaagaaaagccaaagtccctgcaatggagcaaagtccctacatgatcctaggtgatctggttcccacccctcctcccacctcattctctcccttacccagctctcacctcccacctgccttgatgttccttgaatgttcactaaatgcaccagtcatggccctaccaccaggccctcactccagctattccctctccatgcaatactcttctccagaaagctgcttctccaaattcctcaccttcttcaagcctttgttctgaatgaagcctaatcgtcccatgaacgggacttactgtcactgcttgcacctgcatgaaaacaaccttatgcatggagagtgatggagatgagcgtattctagctgggcaaaggcagggtggcagaaaagccactctataccactgtggtcagagccagaggacccctgccgctgctggggtgagaacatgagtaatgaggtcaaagggaaattaagtgacttttttttccccattttccaagaatcactaactttttctttttctttgagatagagtctccctctgtcacccaggctggagtgcagtggcactatcttggctcactgcaacctccacctcccggcttcaggcgattctcttgcctcagcctccctagtagctgagactacaggcacacaccaccagacctggctaattgttgtatttttagtagagacggggtttcaccatgttggccaggctggtctcgaactcctgacttcaagtgatctgcccacctcggcctcccaaagtgctgggattaaagacagaaccgctgtgcctggccccaaatcactaactttcattgttagtgatgcaatttatatatatttttattttcatggaaaaaggctctaacaggaaatatataaagaatataaatacataaagaaaatgtgggaatcttgatcccattcacactagttcctcccaggaggtaatcactggtcttgcttggcatagatcctttatcagcgcatttgcaggcacaggtattttttctaccataaataaatggaatcagactctatgcattgttctgcaatttgctttttttattttaacttgagcatttctgggagatttctgtggcactccatagaggtctatctcatttttataatagcttcccattattccacgatgtggatgaagtgtaatttatttaacttttccactattaatggacatttatatccatttgaatttttacctccttctgtgattcataggctccaatagctccactaatgtcaagctttacaacgctgcggtataaatgaccacatttttctctcactgaatttgtaaacgtcttatcaacaacagcacgggggtagacgtgtgagttggttgcagatgccacgtgtgtgggccacggccgttccttctggaggcggatgctggctgcagtttgtctgcagtgtttcagtggggaagagaaagctcccagaagagggccccttctccatctcaaactccccccgttccccggccattcctctccttctcaggcatagtaaggaggccagcacagttcctaggattccaggtcaaagtgcatcttgccttttgacccaagaaccctatcccattacaaatggaatctcaattaattttacacttgtgggccgggtacggtggctcacgcctgtaatcccagcactttgggaggccgaggtgggcggatcacaaagtcaggaggtcgacaccattctggctagcacggtgaaaccccgtctctactaaaaatacaaaaaaaagttagccaggcgtggtggcgggcgcctgtagtcccagctactcgggaggctgaggcaggagaatggcgtgaacccgggtggcggagcttgcagtgagcggagatcctgccaatgcactccagcctgggcgacagagcgagaccccgtctcaaaaaaaaaataataataataatttgcacttgtgtttgagtatttcccttaactattttgtaagcctactctgtatgaatttgtggtttcctgccctctctagttacatgtctctgtcaatccctgtttctatctgtctgtttcccttttctctcctccaccgcaagatacagaatcccatcctctgtaggcaatcaatatatccttattaatgattattagaaacaatgctgggactgaggaagtggtagatagcaactctgggaaaatcagatgagaattcattactcaacatttcccaggtgcctcatccaagacctcatgcccgagagagcactcagtaccatcttattgattctaagatgctgcccttatcatgggacatttctaaaaccagcgtgggttctatgataaaagtttacatttaatacaatattttttaaataaccaagggcattttatagtgcttctttataatgcctcttaaattcctctaagaatgactcagtagaccctgaccataggaacggagtaaagaatggctacaaaggaaatgttgaagggtaccaagaagccagctgtagggctcccctctctccaattccctcatgcccatgatgtctgaaaagtccaccattcagactctttctgaggagcctaagatgccttgggctccagaggtggtcccctggtctggtgaaacttagcattagctcctgctggctggaatgattgatccagggataggcacagccagtgggaatccttcttagaaagaccttagaacaattagaaaagaccctcctccctttagttggtaataagccaataaaagatcagagacggtgggggtcatctttgccttcatatgaaaagacctcatcgtgcctgtaatcccagcactatgggaggctgaggctggaggacaacttgagcccaggagtttgacaccagcctagaaaacatagcaagactcccatctctacaaaaatttaaaaaatcagctgttcataggacacatttctgtagtcctggctactctgaaggctgagacaggaggattgcttgagcccaggaggttgaggctgcagtgagctatgattgtgccactgtattctagccctggcaacacagcgaaagaccctgccttaaaacaaaaaaaaaagaacagaagtcactggagatgagccaacctgggaaggtagagtccgaagacggagagagggaattctcaaggcccctgtggatcacctgaatccagcccctcacaccctggacccctcctttcagatgccccaaacatcctattgaccccctcccttagggtattttcaaatgttttccttcatttctggaatgttccagcaatactagctaacatgctccactgttagctaataatgccatgagccctgagctcaaagtcctgagctcgaagatctagggaggccttcccaacaccatcccaggcagatcctcctgcctgctggccattcttagcactctctgtatccctttcctatagcattgtccccatttgtaaggacacttgtatgtgtgtatgtgatggtctggttaatgtccttcttccctactagactataagctccccaagggtaaagtctctgtctctgttcatcattctctccccagtgcctctcaaaggcctggcattttgtaggtaaatatttgcaaataaaggaatcagggtctcattttggttgaggtcaactgatcaaagctcagactctaactcagactcctggtttctaagactgactagctgagatcttgggaaagtcacccacacttgtgagcctcagtttcctcatctgtgaaatgggactaataatggtacatcccagggatgctgtaaggattgaatgagctgctatgtgtaaagtactgagaatgagacacagcataaagtcaacatggagcaacagtgagctgtgcttcttataagggcccctttagctgtggctgctactgttgacagtgaaagatccaaccaacgactgatgttttactctgggctttagatttgtcaggatggtgtgttgtctcttgtccccaagccaggtattgaaatgtggggtggggggaacaaaacaactgccaaaactctggagggatgctgggtggttttgtctaggtttggagcccatcacagcccaagaacccctggaccagctatgttcactgaaacatcacatggtatctagagggtccttgaatggcacacttgtcacaactttttgtgctcaaaaacagtcactggaggatcttttaaaagtgcaaattatagatctagagtggggctaatattttgcattgctaacgggtccccaggagatgcctgtgctggtccatggaccacactttgagtaaccaggcagatgtacactgaaaagcaactcccatcgtgccgagaaagctggctggctccagtgacctgaactatttgaaagagtgggtaactgaagaggaaagaaaacagcctgaaatggaaataaatactgtgtaccacaatctcattaatgtctaaaattagattaacataattaaaaatttaaaagctagattaaagcatgtcagcctgaaatccagtggtgaattatgccacagctatctttgctttttccttaacggtttgtgctaatgggtatttcaaagactactgggttacacgttgttctttgtgatttttgattatcaccaaacacatgcaattgacccgatttccaaggagatggctctcccaggacatggctaccatgacactccaaaaatgtaaaatcatgctcaaccttgggccctctcctctgactgccaagtaggcttctttggggaaagaaaagaggcttagttactctccagatggtaggcatgcaccttacatgtgtcatgccagtcatggtgagtggcacaaatattattgaggttcccatttttaatgtattattattattattattcgagatggattttcgctctgtcgcccaggctggagtgcagtggtgtgatctcagcttactgtaacttctcgggtttaagcgattctcctacctcagcctcccgagtagctgggattacatgtgtgtccaccatgcccggctaatttttgtattttcagtagacacgggaatttcaccatgttggccaggctggtctcaaactcctgaccttaaatgatcctcccacctcagcctcccaaagtgctgagattacaggtatgagccaccatgcctggcctgaggttcccattttataagtaaagaaactgaggttcctagaggtacagtaagctgcttgaggtcacatagctaattagtggaagagagctgggatcctaacgcagttccgtttgatttcaaagcatccatattcttttcatggcctctctgaagaataaaccatcacatggttccatttaaggagtgaatgcatatgcacatgtgtgcaggcagaagagtggtgctgccaagagaaatggagacagagtaaacatctaatcataaaatgtctatctctttgtttctgctcaagttgtcatactgaacccattaccactgatataacttactacatatttgaacataattggactaagtgatctgttccctcgccagattcacaaagcacttattagctcaggcttctggtcctggagttattaagtctgttctcatccaccaggagattaggttcctgagggtgaatatcaccttggagacatttcagattgccatgactttaaccctaaaatgggtacggtcgtcttttcctggaataggtggacaaaagaaggcaaagtggggcggggactccgtggagctaggcacgggtcatcatggccatgcgttcatgggatatgtccacacccccgccaagcttctctcttgagtccccagacttgcagtttggccaaaacatctccctataaatctgatttccttccaggaagtgagatattttgaaagagtcttgggagtgaactttgcctaacctaagttacactgggaggatattgttgcaggtaaaggctgcttgctaaagggctgttgctttgaactgcagactgctattctcgtttagttatataagccggagagttatgtctactttggttgttgttgttgagacggagtttcgctcttggtgcccaggctggagtgcagtggcgtgatatcggctcaccacaacctccacctcccaggttcaagcgattctcctgcctcagcctccctagtagctgggattacaggcatgcgccaccacgcccggctaattttgtatttttttagtaaagactgggtttcttcatgttggtcaggctggtttcgaactctcgaactcaggtgatccgcctgcctcggcctcctgaagtgctgggattacaggcatgagccactgcgcctggccctatgtctactactatttttgttttagaagtatttactgaggaccaaatgggtgctggctagtcttctggatgctgagactagagcagtaaacaaaatttggatgctagaggggaatatattaaaaatacagccaaaatgtaaaatggttcagcctctgtggaaaacatatctgtggtttcttaaaaagttaaaccaaattactatatgacccagcaactccattcttcaaagtactgaaaacagatactcaaacaaatggtatacacatgttcacagtggcattattcacaatagcccacaaggtggaaagaattcaaatgtccatcagtagatgaacagatgagcaaaatgctgtatatccctacaatggaatattatttggccatgaacaggaacggcattctgacacatgctacaagatgcatgaaccttgaaaacatcatgctaagtgaaagaagttggatgtaaaaggtcatgtactatataattccatttgtatgaaaatattcagaataggtaaatccgtagagtcagaaagcagattggtggttgctgggagctgatggaggggggatgaggagagaccgtgtcatgggtatggggttttcttctgtaatgatgaaagtgtcttgtaactagatagcagtggtgcgtgtgcaaaattgtgaatggactcaatgccactgaattgtacactgaaaatagttatttttggtaatatgaatatcacttcaatttacaaaaatggagattaataagattatttctgataataagagttaataggaaaattataaagagtaatgaggtgaagggtcaacaggcattgttggtgaaatggtcaaagaggaactccaccagggggcgacactgaggagatattgatgacccatgagagaaaaccttgcaaggactggggcagagctttgcgggcaggaggaagaacaagaacaaaggttgggaggcaggcatgtggtgggccagttggatgccagcatggtgattaaaggtggatgcgacaagagcccataatgtgaggtagacaggagctggatcctggaaacttccctgacaggtcagaaactcgtacaaatatttgaactcagatatcaggggaagccactggagagttacaaccagggaacatatactgatttgcatttttaaaaatcgatgtagggctgggtatggtggctcacgcctataataccagcacttttggaggctgaggcaggggaatcacttgcggtcagaagttctagaccagcctggccaatacggcaaaaccccatctctactaaaaatacaaaaaaattagctgagcatggttgtgggcgcctgtaattccagctactcaggaggctgatgcaggataatcacttgaatctgggaggtggaagttgcaatgagctgaaattgtgccattgcactccagcctgggcaacagagtgagactctatctaaaaaaaacaaaaaacaaaaaaacccaacaaaaacaaattgatgtaaaattcacataacataaaattaaccgtgctgaagtagacaattcagtgggctttagctcattcccagtgttgtgcagctaccccctctcttgttccaggatattttcatcagcccaaaaggagacactgtattcatagtcagtcacctcccattccctgtgccccaaccgacaactaatctgctttccttctctatggatttccatatttggggtgcttttaaagttaattatttatttttgagacagggtctcattccgttgcccaggctggagtgcagtggcatgatgttggcttactgcaacctctgcctcccagcatgcaccaccatgtctggttaatttttttgtagagatgggttttgccatgttgcccaggctagtcttgaactcctgagctcaagtgacccacccacctcgacctcccaaagtgctgggattacaggcgtgcaccaccaggcccagctaattttgtatgataatggaaattttattactctataaaacataccaacaattgagcaaagactgtccaaaaaattgttcccatccccaggactcaaatctccccactatctttcacttcaaaatcagaccacagctgtctttgtacaatttttttccaacatttagaattttaccacatctagaagttctcaggtcaggtgattctttaaacaatcgtgcatctatctgcttgcattgacattcccccgtctacttctgcagatgaagtctcaaccattgtcacctcctccccaggcaatggcagtatgtaggaatgtaaaacggagcagccagtgtggaaaatagttcagcggtttcccaaaaagttaaagaatgatcacagagcctagcaattctgctcccaagtagatgcccaaaggaattgaaaacaagtgttcaaacaaatactcttacaaaaatgttcacgacagcactagttataaaggccaaaaggtggaaacaacccaaatgtccatcaacagacgaatggataaagaaaatatggtatatcgatacaatggaatattattccaccataaaaaggaacaataaactgatacatgcttcaatgtgggtgaaccttgacaacagtctgctaatggaaagatctcagacacaaagtcatatatggtatgatgccatttatataaaacatccaggccaggcagaccactccatctcaaaaaaaaaaaaagaaagaataaaaaagaaaatttccttgccagctagcttgaaaatctctcttggggcccaaattggccttgtttaggaagacactttgatgagtatctgggaggaaaatgaaaccctgaagtcatctgtcaattaaaaccaaagtccaggaaaatcaagttttaaaggtattccagaatttcccgtagtatggaggaaagaaagagacaggaggtgagagaggcatccagtgacaaaatgtggctgcctgagggtcattagctagtgaagaatttctggtgaactttgttgaatcctctggcttcaatcctttccctgtgagaaggtggggaaactcagtcccagagcagcaaaatgcttgcaaaaagaggataatggcaagcagggtgcagtggctcacgcctgtaatcccagcactttgggaggccgtggcaggcggatcatgaggtcaagagatagagaccatcctggccaacatggtgaaaccccatctctactaaaaatacaaaaattagctggatgtggtggcacgtgcctgtagtcccagctactcaggaaactggggcaggagaatcgcttgaacccaggaggcagaggttgcagtgagccgaaatcgtgccactgcaccctagcctgacgacaaagtgagactgtctcaaaaaaaaaaaaaaaagaggtaatggcaaaaacaaaaatcaaatgtgctttctacttttctcctgctatagaatgtttctgaagcacttctctaaggagagacaaatgaatgcccaagctatactctctataaatttacacttacatgaaaggaagaagtcatcccttcattcatccatctatccacccatccacccatcaatccattgatatatcagtttgtctgtccatccattcatcttcctatccatctttccttctatccatccatccatccgtccgtccgtccgaccgtccgtccgtccgtccgtccatccatccatccatccatccatccatctgtccatccatccaaccatccatccatttcatcaattaacaaatattttagcacttaatgagctgaagtcagggattttcattgcaggcctataggccatgaccaaacatttgaattttattctaacagtaatgaggttttatgtaagggttttaacctggggctagcttcatcttatttaagttataatgattactttggaatatggaagatggactggagggagcaaaagcagaaattgaaagatgtatcatctaaataacacagtccaacaatcctattgccttcaatcacatgggcttctgtgcaattcaacaggcaccttttacaattttttcaatagatttttggcgaacaggtagcgtttggttacacgaataaatactttagtggtgatttctgagattttggtatacccattacccaagcagtgtgcactgtacccaatgtgtagccttttatccgtcacccccaacaccctttccctgagtccccaaaattcattgtatcattattatgcctttgcatcctcatagcttagctcccacttatgagtgagaacatacaatgtttggttttccattcctgagttacttcacttagaataatggtctccaatcccatccaggttgctgtgaataccatcatttcattcatttttactgctgagtagtattccatggcttgtatatatatcacaatttctttctatatcacaatttatttatccacttgttgattgatgggcatttggactggttccatatttttgcaatggcgaattgaaacagacacttattgagctgctactgaataccaggcccagtcaatctgggtgcagggatgaccactgaatgtttccttccctcattggagctgatactacagtggtggatggagagaagaaagctgacaattgtgaccaggatgggacagcagatacacagatgccaagacagtaagggtggaggccttgacaaagtctaataaaggcagaggtaagccctccaaggggggcttcttggaggaattggtatttaagctgaggatataaggatgcctgggacttggctgggaagtgtactcttagcaaagaaaacagggtgagtgaaggcacaaagcatgacactgcagagtttcacgtgggaagccacaagagcccttcaggaatgaggcagaatactacatgggtatgtgcgtggaggggttgtgggcaggcgtggtgacagctgacaactggggtcactatgagtagaaaatgagactcgagataccagtggaggctaagtcatgacagatcatatgtagattacatcctgatggtactggggaggtactgattataaaaaggagagggtataaatcccccttcctttgcttctttctgagtacagagccatggtctgagcacatctggatgagaaagaacgtttgaaggctgagcccttaggaagcaaattccatatgccatttgttggtataagatgtttatgtggggaacatattttcaggtgcaattatttctcttgcaaaaacatgacctgtttctcctattatacttatcatctatttattttgaagagtgagaaaacagactttaaaaatgaacaaaaatttaaacctgcaattttttcatctagtgataactgttactattttattgtatgatctgtcatttaaaattacataatcacgacttttctataaatgggatcatagcctgcacactgctttattagttgcttttttagttggaaatacagcatcaacagcctctgtgttttcttccaagggctgccaaaacaaagtgaatggcttaaaacaatagacatgtattataggtttagaggctagaagtccaaaatcaaggtgcttgcagggccaccttccttctaaatcccataggagaatccttcctggcctctttctggcttatggtggtcactggtaatctttggcgccccttggcttacagttgcataaccccagtttcagcctttgtcacttgacattctccctgtggctctctgtcctcacatggttgtcttcccatgggacaccttttgtgatggttcatgctgcatatcaacttgattagattgagggatacaaagtattaaccctgggtgtgtctgtgtgggtgctgccaaaaaagattaacatttgagtcaaggggctggggaaggcagacccacccttaatctggtgggcaccatctatcagcttccagggaatacaaagtaggcagaaaaacttgaaaaggagagactggtccagcctcccagcctacatctttctcccgtgctggatgcttcctgccatcgagcatcagactccaagttcttccgttttgggactcaaactagctctccttgctcctcagcctgcaggcagcctattgtgggaccttgtgattgtgcaagttaatatttaataaactcccctttatatatatttatatgtgtatatatatgtgtgtgtatatatgtgtgtgtgtatgtatatatatatctcaaaaagttaaagaatgatcacagagcctagcaattctgctcccaagtagatgcccaaaggaattgaaaacaagtgttcaaacgaatactcttacaaaaatgttcatgacagcactagttataaaggccaaaaggtggaaacaacccaaacgtccatcaattatatatatatatatatatacacacacatatcctattagttctgtccctctaagagaaccctaatacacctttcatattggactaggggcccaccttactccagaaatatctcgtcttcactaaacatctgcagccaccctatttccaaggaaggtcacattttgaagtactaggggttaggactttgtgaaaggaaagtaccttgggcccccaaaatcgctaagctaaaaggaaaattcaagctggaaactgctgagggcaaacctgcctcccattttattcaaagtcatctctgtgctcactgagatagatacatattctgattgcctcctttggaaaggcttatcagaaactcgaaaggatgcaaccatttgtctctcacctacctgtgacctggaagccccctccctgatttgagttgtccctttgtccccgcctttctggacagaaccaacgtacttcttacatatattgactgatgtctcacgtctccctaaaatgtataaaaccaagctgtgccccgaccagcctgggcacatgtcgtcaggactgcctgaggctgtgtcacgggcacgtcctcaaccttggtaaaatacactttcaaaattaactgaggcctgtctcaaatttttggggttcacaacttcgactttttttttttttgagatggagtctcgccttgtcatccaggctggagtgcagtggcacgatctcagctcactgcaacctccacctgctgggttcaggcaattctgcctcagccccctgagtagctggggctacagacacacaccacaaggcctggcaaattttttttttttttttttttttttttagtagagaagggatttcaccatgttggtcaggctggtcttgaactgctgactttgtgatccgcccacctcagcctctcaaagtgctgggattacaggtgtgaggcaccacacccagaggacatatcttttttttttgatgggggagactcggtgtaactcataacagcctcacttgccatctaacactatttttactggctacacactattacattttgtaaatgtacaaatgtccctgggtccatctttgtcacactgaacaagcaatctgctgcgtgtccttgtcctgccgtgtgtggtgacagcagccatcagcctgagcactgtgatgctgggtaccttccaaactcacccaatcttccgctccctgctagttgctactgacagaaaaagacggtggactcaagttctctgaaaatcctttcaaacacaagggcaagagcaaaaaggaaaacttcacataaccagaagagtcaatggatcagaatttcccccaggcattctggttcatgcagatttgaccacattttggaacaaaaccagttctaagtggtctactcatcagttgctcacctgaatgcaacaattactattattattttttgagacagagtctcgctctgtcaccaggctggagtgcagtggcacaatctcagctcactgcaacttcacctcctgggttcaagcgattctcctgcctcagcctcccgagcagctgggattataggcacacgtcattaggcccagctaatttttgtatgtttagtagagacggggtttcactatgttggccaggatggtcttgatctcctggccttgtaatctgcccgccttggcctcccaaagcgctgggattataggcatgagccaccacacccggccataacaattattttattcaacctgccttatgaatgtaggcaaaaagcatccaactccagtttcccaggatatcactcattatcccaaaagatgtggcagcagcctagaaagcaagtctgttttaaaccataaaacctcccctttgtgagcaggagaccttccgcaccacgtcttcacacacacatggagcaacagtactttgtgttgcctgttgcggctgtaaagaggttttcatgcacactggcccatttgattatctaagcagtccagctggaaggtcaggaccattcatacctgaggctttggaacatcctgacttgcccaaacctgctcagcttataaccgccaccaccacaaatcaggaattcagccatgtgtggatagacagtcttattcaatcttccccaaaacataagaaagtgctgtgttcttttcccttctagagaaaaataaactaacccttaggaaacacgctacctgacccatgctcagacagttagacagtactggaactgggtcttgaacccacactgcctccctccccaggccatgtttgtaaccacaaagctaacttgtgctgggctaagacagacttttaactccttgaatcttgactctttttgccgcatgacctggtttggttcaacaatggcaatttatctctatttaaaagcagatgttgggacgggcatggtggctcacgtctgtaatcccagcactttgggaggctgaggaaggtgggtcacctgaggttaggggtttgagaccagcctgaccaacatggggaaaccccgtctccactaaaaatacaagaattagatgggcgtggtggcgggcacctgtaatcccagctactcgggaggctgaggcaggagaatagcttgaactcagtgggaggaggttgcagtgagccaagatcatgccggtacactccagcctggttgacagaacaaaactccttctcaaaaaaaaaaaggaatggatgctggctgggtacactggctcacacctgtaatcccagcactttgggaggccaaggcgggcggatcacttgaggtcaggagattgagaccatcctggctaacaaagcgaaaccctgtctccactaaaaatacaaaaaattacccaggcgtggtggcacacgcctgcagtcctagctactcaggagctactgaagcaggagaatcactcgaacctgggaggcggaggttgcagtgagccagatggccccactgcactccagtctgggtgacagacgtagactctgtcaaaaacagaacaaaacaacaaaaatgatcttttaaagttacttactatctaggatacctgctaggctgtaggctccgtctggaagtgtgtgacaacttaggtccttgataagtatttgccaagaaggagaagggatgggtagatgggctgggctgtctgcaaagttgaagctcaccagaccccagcttccttccttctgggatgcatgaaacagagaagtgtcaaaatgtccagcaaggtaaatgacttcctgctccaaagcatggaaggctcattttcaccccacttagcagtgaattatgttacctgctggtgaggacaactccaggaggcccgtaattagttccctgattattcacaattgaagcgatcacggctaactgatggtgttcccacaaaaacctgtaggagagccaggccatttggcagcaactgcgttcccaacaaggcagatcaatttccgtttgatttgtttaaaaataacagataaacaatgcggagcagctcgcaaggtttgggttcctcctttcctaaaatttgaggaaaggaggccgtttgaaattaccagttaggaataaaacaggcagatcacattcgtggctcaatcggattcccctataatcagagctaataactgtatttttctgctactaaacaattctgttattttaaagctaactataccgagctggctaaataatactcaggggctggccacagagaagactccctctgaaatgcagcgatgatgcccactttttcctactttgttctaattttgtccccagctgatgggtgacctgctgactcttgctgggagagaggctggagggatgtccagggagattttttaagaaacctagaatctcacacctttccctggaatacaaagggaaccaacccatgtttccttgaggataatgaattttaaaggcttctcgacctggattcactcataatctgagctcttccttgacctctgctattttccaaatatctaaattccgtccctttctcagctaagtccttcaatgacttcccactgccattaagatatgcctaagccacttaggtggctggcatggccctgtctgccggtccctcacctacttctctggccccaaattcctccatccacccgcaactccctttccttcatgttcccactacactgaattatgatctgcatggagcagcatgatagaggctatggactctagcagccagggtgcctgcttctaactctagctccaccattcatcagctgtgtgacctggggcaagtcatgtgacctctttgggcctcagtggccacatcgataacatgggaatcatagaagtacttgccctgtaatgtagctgtgaccatagatgcattaatgactgcatggtgctgagatggtggttggtgcaagcccgtgtgcctggcagagattggtcgtttgtactactttttgtttgtttgttttgttttttggagacggagtttcactcttgtcacccaggatggagtgcaatggtatgatctcggctcactgcaacctccacctcctgagttcaagtgattctcctgcctcagcctcccaagtagctgggattacaggcacccaccaccatggttggctaatttttgttttttagtagagacagggttttgccatgttggccaggctggtctcgaactcctgacctcaggtgatctgtccgccccagcctcccaaaatgctgggattacaggcctgagccactgcccccagccagcactactcttcaaaggtgcttttttttttcctctttgcatatgtggtttccgttgtcaggattactctttctgtctctaattctttgctttcttatttgactcatcttttggtatttagcttagacgtgacctctgcctggaatccttccagatgccatagccttcctctggagccaagagcatcctcaacttcctccatcatagacatctccccctgtggattgtaattacatatttgtgtgtgtcttatcgccaccaccagggtttctcagcctcagcactactgatctatcgacatttggggccagattattcttggttgtggggggccatcctgtgcactctgtgatgttcagcaccacccctggcctctacgcactagatgatggcagcagccctcctcaacccctagttgtgactatcaaaaatgtctccagacatggcctagtgtccctgggtatgggcagatatgaaattgctcctggttgagaccactacactaaaccataagctgaggggacaggaaatgtgtctgtctttctcatcccaattctctaagcacctagaatagccccaagtgattatttggtctttaattaatgtctgcggaacagaagaatgtggattctggggccaggagcggtggctgatgcctgtaatcctgcactttgggaggctgaggtggaaggatcaccgaaggtcaggagttcgagaccagtccagccaacatggtgaaaccccgtctctgctaaaaaaaaatacaaaaaattagccaggcatggtggcacatgcctgtaatcccagttacttgggaggctgaggcaggagaatcgcttgaacccgggaggcggaggttgcggtgagctgagatagatagtgcaatagcactccagcctggacaatgaagagcgaaactccatctcaaaaaaaaaaaaaaaaaaaaaaaaaaaaaaaaaaggagattctacactgagcagcaaagcaaatcaggtcaaagtgaaaagacctgagttcccctcctggatgtgccagtccctggctgcatgacttggagaggcccaagtttggttctttgaagtgacttgaatgagcatccttgtgtggtcacagacagcagcatcagcatcacctgggaatttgctagaaatgctcattctctggatcccccagaccagtgaatcagaattgcagggaggagctctgaaatttgtgttttcacaagctctctaggagtttctgattcatccttcctcagttctcagatcacccctggccaatcttagaattcacctggaatgctttttaataaaggatgcttaggaggctagattttcccggtccaagtgcataagaagctctggcattcaggctggccatcggtgtttttcacctgcttcaggtgattccaatgcacacacagccaggactgagatgttctcgacgcgcagaggctgttctaaatctctgtgcttcccacgttaaagcttttgggaactgcattaactctttcagtccaccagagggccatttacagtgctaggaaagggacagggttatcatttcatgtcctggggcacatggagccatagaccataagtacacaggtagaagtaagtgtccaagaccttcctctctagctgtacctggaaaaataccagaccggaatgtgaagcatcagaaatgactctaaggcttgactcatgctcttgcaataaccctgggacagccaagaggaacaggccaacctcaaccaggattctctatttaacccactagttttaaaagccatgtccaagaatcctctctataaattcatttttgaagccctccgtgtccctgggttcatgaaagcttttttgttcagaaggtggctgcagtttattatacagagtagatgcgaagccagacatacctgtgtttctgagaacctgtttccctcctctggatctcagattttattattttagttttttgagacagagtctcactctgttgcccaggttggagtgcaatggcatgatctcggctcactgcaacctccacctccgggttcaagtgattctcgtgcctcagcctcccggagtagctgagattacatgtgcctgacactacacttggctaatttttgtatttttagtagagatggggtttcaccatgttggccagactggtctcaaactcctgaccttagttgatccacccacctcggcctcccaaagtgctgggattacaggcgtgaaccaccgcgcccagcctggacctcagattttaaatgagggtaatgaagcttagctggctaggctgcgatgaggttcaacataggtgaacaggtgaaacaccagcctcaaacagtcgcttagtaactctgtggttctcaaaagcaccctgggatgtggttctcaaaagcaccctgagatgcggttctcaaaagcaccccgacaccagcagcttcgtcaggaagcttgctagaactgcacattttcagatgtctcctgccctacccccgccgcaagaaaaatactgaattggaaactttgggggtggaataacttagcctctctgagtctcaattttctcatttttgaaaccagaataacagtacctgcatctcagagacccactgtaagggttaaatgagctatgtacatcaacttcttagcacagtgctggcatacagcaagagctcagtaaatggtagctttcactgttattgcaattattatcatcttcaaagctccctgccccatgcaagccttagaaagaatctttcgtcagaactctgcacaagtatctcttattgaactttgcaaaataccgtattttggctctgaatgctccctgtggactacaacttgcagagcaggagctcagtacaccaatatgccctgtgaatacctcagccaacattataactcattctgagagatgccatctgtgttagtccgttttcacactgctataaagaacttctctgagactgggtcatttataaaggaaagaggtttaactgactcagttctgcatggttcggaggcctcaggaaacttacaatcatggcagaagaggaagcaggcactttcttcacaaggcggctggagagagaggaagaagcacaaaggactaacttccaaactcttataaaaccatcagatctcatgagacctcactcactattatgagaacggcatgtgggagattgcccccgtgatccagtcacctccttctcttgacatgtggggattaccagtccccctcttgactcgtgggggttacaagttgaaatgagatttgggtggggacagagccaaaccatatcaccatcgctcggagcaatacaactatttactgtagggtcgcattatggattgtgatctatttagttctaccccgctgtcagaaagactggctttccctccaccaaccaggaacaagcgaatgggcttggggcaaggaaaagaacaacaaacaaacagcaaataggacctgaaaaatattacactcatggtcagagaaaatgaaaaagatactgcaggagggaaactgagtcagctctgagtggccttgcggcagtgacagagaactttccagacgaatccatggaggcagaggggtgtctgatatttgcatctgccagctgtcagaaagagctggattttcaaggtggaagagagataagtggaaggtgggattgaaatttaccttcatgcaggtttcagtaatcagggtgagaagtagagaatcctcagctgaagatagttactttctgcaaaagtgggctttcctttctttctcttttcttgtaagggattattttcctgctcagtctcctgagtctcccccagtggccccagcatctatgacccaccattccctgagggcttaactggtcattagctaaaaagaagttgaatgaaggtggggctctctgcagttattaagggttgagaatgcaaatgccatgagagggaagaatttatctgaaacatatgagcaacagcaaacaacggacactgaggactaaggaatgcatgcctcaattaaaagcatttacattgaaacgcaaaattaaagccaattacattgataaaactaatgaaatatggtattaatacataacacacttattgcctgtgtgacttaactgtgtaataacaataagaatggcagcataggactagattccagttgctgtggcctcaaaagggacggatttgatcgtacttgttcccacttcctggaaaatagtggcttttcatgatctggcagctgaagcagcagcaccatgctgctgtaagtgctgctgatggggatttattcaaatgtgaattagacgaagctggtttggacaggcgatgagtcggggaacgctgggacatcctccctgtgacaaagtcctttcacaagcaaagactccccagcccaacagtgatccctgggtgtttcaagaaatccattcagcctgaagtctgaatgccagctctgctacttttagctgcatgatcttgaacttgttctgaatggctctgactcagtttccccatgtggaacattgggaagattacacttacctcttggaattgccatgaatcaaagacattgttgactaagtgtccagcagtgtacccggcacacagtagactttcaaccaatagttcttattgatagtattattatcatttattactgctactaccactacatccctccaaaaattgatccaggatgggtgtgtcaaatggcagggtaaattattgttaagaatggaggaacagcagactacagaattttaggagaatgtattattcttaggagatgcatgctgagttatcaggggtgaagcatcatgatatatgaaatttactttcaaatggttcagaagaacattgtgtgtgtgtgtgtgtgtgtgtgtgtgtgtgtgtgtgtgtgtgtgtagagagagagagagagagagctcctgagagagcagaaattgctgtgtcaacaattttgaatctaaggcaaaagatacgcagatggtcattatactatactattctttcagcctttgtctggagccaggcttcctacgttcaaatcttcactctctcacttactagctatatgataacttctggcaaattaaagaaacactcagtgcctcagtttcaccatcttaagatgagaatcattaaaatgcctaactcaaagggcttttgtgaggacgaaatgagttaatgtacttagaatcatttattgaattaggtgctcaatgtgtgctaactccataattagctgtttgtgattagatacatgtataaatagatgggttgatagaggtggataataagatggggagaggaaggagggagaaaaaagtggaaggaaaggagggaggaaggaaggaaggaatgaaggaaggaagtaaggagggagggaggaaggaaggaaaggagggaggaaggaaggaaggaaaggagagacagctggaatatctcatcactcatagtgagtaatgttttatttgtagttttcagtaaacttcaagtttctgcacttggcataaatgaggtaaacattatcaatgaggtaaacgttattacaaacatatatgtaaattatataatgcccctacccaggttccagcctgcaaacccagctagaagacgttgttctttccacacaggtgttcatcactccttgcgggcatgggcaggagcttggaacagcagagtttttgagacctggagtgatcccctggcacccagagtagaggtgcccttgcttcccttccgtctgctccttctcacctgccctccaaagtcaatttcagtgccatctcactgtcagtggtgcccttgtggatacgggagtcctgttcggccgaggatggagtctccctaatggtaatgcatgcagaataggactggcacctggattgcattttaaacacattccgcaccattaggccatcctcatcattcacaggactgacggcagagttgcgggggcctccaggcccagcagcaagtccagccggttcatccggtcggggcatcctgccaagacccttcagctgtgaagcggccactctaggcacaggtggggagacctgatgagcagaaagcagcctggagtctgcctcctgggaatgggaacaaggattagggggccaagccctgaggagcatcccagccactctcctgggggcacagattctacccattggaataataagtgctttctttttcacgcgcctctctccaacttgctctagcactgcagccactctaaccttattttcctttctccaacacacctggaactttctttacatgggaccttgacacaggcaaatccttctctccagaacattcttccttctgctggttcccttcttgctgtccaactcacctccccaggaagccctcctagatctcataatatcataatatcaagaggttgtccctgcctcattgtcttttaccttttatttacttatttatttagagacagagtcttgccctgctgcccaggctggagtgcagtggtgcaatcttggcttactgcaacctccgcctcccaggttcaagcgattctcgtgcctcagcctcacgagtagcaccgtgcccagctactttttgtagttttagtagagataggttttcaccatgttggccaggctggtcttaaactcctggcctcaagtgatctgcctgcctgggcctcccaaagcgctgggattacaggcgtgagccactgcacctggtcttttatcttgatactttctttcttttcctctgtgcctcagcttcctcctttgtaagtggggtaacaattgtgcggaatgtgctctatttggtcaacttttctaccatgttctacattcctttggctgatcagttggttctcatgtcctctgtctggattcagtcaatgagaggcaggcagagaggagatgggactattgattgatcccctgggcttacatgcttacctgttgggtggcgctgagttcctcttttcaagctttctgatggacagctgtgttcttggctctattaggttggtgcaaaggtaattgtggtctttgccattactttattttttttgagaaagagtttcactctgtcgcccaggctggagtgcagtggtgtgatctcagctcactgcaacctctgcctcctgggttcaagtgattctcctccctctagagtagctgggactacaggcacccaggatgcactcggctaatttttgtatttttagtagagatggggtttcgcatgttggccagcctggtctggaactcctgacctcagatgatccacccgcctcggcctcccaaagtgctgggattacaggcgtgagccaccgtgcctggcctttggccattacttttaatgaaagcgtccctccggtgttccttcagcaccaagggtggtaacagctccctgatgtggccagcgcctcggtgcttcactgtcccttgttggtttccttgggtcctgcccacacctttgtaaattgtcccttcgctgcactagcctcagtaatggctcagacagtgtcatctgctacctaccaggactctgatccacataataatagtccctatctcatatgttgtgaggattaaaatgatttcagtgcaggatacacagtgctaagattattatttgctattattctccttcctctcacttatcacactttgcacttagttgcaatgctaattgctcactacttttccctctggttaattgacaatttgcatgaagagggagtctctgtctgtgcctgttcattcaatctcgtgatggtccagtgttagatgcaaaataggtcctcagaaaatatctgatgagtgaataaatgaatgaatgaaagaatgagggttggttttcactttccaaagcacttttatatatcatgttgaattgtgtggtagcatgcatattcgattggttttgtttgataaacacagtaatttcacaagcctttacctattacattatcctctttgatccatgaagaatagtcacaatttaataaataattagactgagaagaatggagggaaaagtagaagggggaaatgctgcctgagaacctattatgtgctcagattttccattagcatttgatggacatgatttattttgattttcacaatggttattatcataacgacagaagcatcattattccctagtttacatatgcagaacacaggacagagaacagttggaagactcacccgtagttactgtattagtcagggttctctaatgggaccgaactaacaggatagatgtatatataaaggggagtcgattaaggagtattgactcacacaatcaccaggtgcgctctcacaataggccatctgcaagctgaggagcaaggaagccagtccaagctccaaaacaacaaaaggagggaagcccacagtgcagccttcagtcagtggtcaaaggtccaagagtcccacagctgaagaacctggaatccgatgttccagggcaggaagcatccagaaagggagaaagatggaggctgggagactcagccagtctattctctccatgttcttcaacctgcttttattctggccgcgttggcagctgattagatggtgccctcccagattgagggtgggtctgcctttcccagtccagtgactcacatctcctttggcagcaccctcacaggcacacccaggaacaatactttgcatccttcaatccaatcaagttgacaatattaaccatcagagtcaccaagctggagggtcatagaactggactccagacctcatgtgtttcactcaaaatgtcatgcttttcccacacagcagttatcccactgagagaccccagagagtctcttataatgcatgcagggaaaggtataaacaagtatctgtttgtaatagcaaaacaaatggcagcaaccccacgtgtctattgggggagaaagggtaaataaattgaaacatttaaacactgaaatagtgtggccataaatgtgaatgaactagaggtgcacatatcacctgcaataagtgtgaaggaaaaaacaaattgccagaaaattccttagtgtaataccattttatatcaaggtttacaaatatacaaaacactgctatggttgggagtggtggctcatgcctgtaattcccacactttgggaggctgacgcaggcaaatcgtttgaacccaggggtttgagaccagcctgggctacacggtgaaaccctgtctctacaaaaaatacaaaaaaaattagccgggcatggtggtgcatgcctgtggtcccaactgctcagaaggctgaagtgggaggatcgattgagcccaggagatcaagactgcagtgagctgagatgacaccactgtactccagcccgggcaacagacggagcccccatctcaaaacaaaagcaaaaacaaacacaaagcactactgtgctttatttaaggatacaactatgtcattacaaagtgctcacattcaagaaatcacacataccaaattcaaaattgtggtagaagggattggatgatactttaggggagtgacttaggggtctccatggttcctgtgatgcttttcttaagaggggagggggtttgctatattattttatacttttttcttcttaacagaaatgtctcatttataaaaaagtggtaccttgcctaaggacacccagctggttaaggatggagctggacatgtacataagccttgcgactcctggctcagtgctctttcccctgcggtgagctgtccaaaaacggggtaattatctcccttgtgcaacttgggaagaggtgaaacgcaatgttgagtaacccttccttgcttccttccttccctgattacagccttaccaacaccccggataccttctttcaagttgttcatgttgcctgcctctcagagtatagtttggtttctgcacggcttcagtgcaaaaaagagaaacttcctttcattgactcaatcagaaagtctcagaaagatcagagaaagtaaccatcccatcaagaagctggcgtggggccgggcgcggtggctcatgcctgtaatcccaacactttgggaggccgaggcgggccagtcacctgaggtcaggagttcgagaccagcctggtcaacatggtgaaaccctgtcactactaaaaatacaaaaattagccaggcgtggtggcaggcgcctgtagtcccaggtactcggtaggctgaggcaggagaatcgcttgaacctgggaggcggaggttgcagtgagctgagatcatgctactgtactccagcctgggcaaaaaaaaaaaaaaaaaaaaaaaggaagctggcatggcaggcactcttgtctgcctgcttaatgattctatgttagcagggaccgtctcctataatagaagtccgaaaagggggctactcattttcccagcctccccatggcatggccggtaacctcatctccataaagggaaaatctgctgaggggtttctgggaaatacaccccctgttggtaaaaaaggagagatgcaagaaagatgccatctctctttctgctttgtatgttgtcatgcaagaatgtgatgtttggagctgtggcagccaccttgtaaccatgaggaaaggaccaagagaataattaagaagctattgctgacctgttgaataatctcaagccacctatctctcaattgcttcttaagtgagaataaaaatgaatcaatattgtgtatccacttttactctagtgttttcttcctggcaaacaaaatcacatcatctgactctcctaaggaaagaaagataagcaggcctgtggtccaggtacaaaccatctagacacaggcacttacatgccatctgcacacatgtgcttagatgggatctaggataaatagaagtttgccaatcccttgattagcccttgccataacttctacctgttctttggataagagtcaaaatcttcggcaagaccttccaggcctggcccaactggtccctgcctgcttcctgcctcaacctgggccactctccccatatgactcacaaggttcccacacataagtcttgttgttgttttattttggtttggtttctccagtttgccaaaaccttgtcaattcagggcatctgcatcagcttgtccctctgcctcaaaagtgccttccctcactctttgcctggaaaacttattctaaatcttccattcttgccctaacaatgatttcttcagggaaaccttcccattcttgatagattcctaatatttatatatctcataggacgatgttttctccttcatagccctgatcgtctattatattttcttctttttctgtgcatttatgtttctttgaccgtctccaacaatggaatttaattccactggagcagagactgtgttggacttcagtgtccctccactctaacccaaaatatgcaccatcgccctactttctcaaagtgaaggtctgggcagatcacctccattttcaagactagttaagataataaatgtggctgggcgcagtggctcatgcctgtaatctcagcactttgggaggccaaggtagagggattgcctgaggccaggaatttgagaccagcttgagcaacatagtgacactccgtccctacaaaaacatttttaaaaaattagctggatgcggtgttatgtgcctgtagtcccagctacttaagaggctgaggcaggaggattgcttgaacccaggagttcgaggctgcagtgaactatgatcacaccactgcactccagcctgggtgacaaagtgagacactgtctcaaaaaaaaaaagaaaaaagaaagaaatgctagctagtattactattatgtctattcattttctagagttaaatttaaattccttagcctggcatttacggtcacatttaattcatctccttcttcattcattcagcaaatatttattaaacaccaacatgctccaggcactgttctaggcaataacatacctttcctcctttatcttccctccactcctcactaagtcatctgccattcaaaccacctcaacttcattcacattactcaagtttttctctaaaccacatagtaaatactattttttccatatttttcactcaaattctttcttttgcctaaaatgcctttctcactctgtatatttccaataactcctcacctatctttcaaactccaccctcattattttatgcaaaaatatttattaagcaccttttatgcatgtcctggtctcatacatcggattggacatgcaagagaccaggaagtgcatacaaagtgcttaataaatatttttgcaattggagattccctggggggatgggggggatgggagggatgcaggtcacgcgtgtggctcttcactgttcttacgcaatgtctgacgcatagtcagtgcacatggtctgctgaattgtggggaggaaaaaacagcttgagaagcccctttcgctttcaaggcttaaagcctctgagccaagggtctccaaatattttcgatcatgaacacctccctccaaaaaagtgaatgggcaccccagtattagattgattttatatttaaacattgaattatatactcttcatatgataatgcacaagccaaagaaagagactgaaagcatgagattaaagaaagtaaaattcagtagaaattctcacagttttcatccagcatttcttggatcaagttacccatccccattttagagactggtctaacctcagaagataactgactctggctcacatggcggggctaagaggatctttcgggaaaggcaacgcattttcgttgcaatgacagagaagtagttggcctggggcttctacgtctgttgcttcccatgaccctggcatctctgttcattggagcttccttggatcttgccccttgaaactaacagatcagctacttttttcctcctcttccttgcctcatccatgacctggaactgacctcatccatgacctggaattgacctgcctatcattgaaataattgaaattgaattatttccactataatttcattgaaataataagcagcaggctgtaaatccgggttgaacttgagagctggctaggaaggtaccaggcccttctcttgcttggggttttcctgcagatgaagcagcaactttgacttctcaaggtaggcggggaatttctgtgaatgtctcatgcttggagaaagcaaacctgccaggggacgtgtcccaatactgttttcttccgtgcatcacaacaatttatgaagagccacgccatcgccaccctaatcctgctggctccttctcaaggcaaaatgagtttcggctgcttccccaggtgtctctagccccacctctgcaggaagcagcccccttagaaactgcctagccttcatctctgacaccctgtcaaggccagcaccctgagcctggcctgggcacattgtttaggcctagggcttcagcacaaactctttgccaggtgccccctctgggagtggccaggaacttgggagtaaaaccgccagatatcctattaagataaccagttcttttcatgccctgggccctgcatggcagttagggtgaccaatcatcccagtttgcctgagactgtctcagtttagcactgaatgtcccatgtcttgggatattcctcagtccaggaaggactgactacataatttgcagggtccagtgcaaaattaaaatgcagggaccttcttcaaaaatgatgaagattttcaagattgtgacaacagggtgttaaaccaaataaggtgcccttttgaccatggggacctatggacctatgtgtctgcacaagttacacactcatgaagccatccctggtcccaggcaacccatgacagttgctaactctactccctatacagagattcagaaaaaataatgtattgttaattccacgaggttgttggtttcttacagaaacatgtgctgagacaacagctcttgctcccatctttctatcctccccacacctatgccagagctttctgaaatacgaaatcatgccacgccccaacttaaaccctcccgccatcatattctcaaatgtgactaataatagtaatacaaattgcagactcctggtattgacttcagttatttttactatactgttgcttaagtatgtgccaacataaaactcggcgtaaactttgtgtgctaatagctcttatacaatggtaaaaccacacttataaattaaaacgataagactatagaaccaataaaattcaaaggaacaacattcatttaatgggacagatgagttcgttttgccaaaactaaaatgccgctcgcagagtgattatggccttgggttggctgcagcaaagtgggttatttctcatggaggtgcttcttcatgctctggtccccacatggcttagatccttactcgggacccagctgggatatgtttgtttgaacaccatgacctgacactctttgaaccttacttggtacaaaatcaccctctgtagatcaaatccacctccgatcttttcccattaacccatgatgctgaaagacatactaattggcaccaatggtatcataaataaacatgcaagcatgggcattgaaatcgcattgcagtgtcaggttataaataggccacctagataaactaaaaatgcctacattaatttaaaaactatcaatgaaataaaaagaatacaacaataattagcatttgttgagcaactactatgtgacaggcactgttctaagaacttggcttgtgataacttattccatcctcacaactctgtaaggccagcactagtattaatgccatacgacagatgagaaaactgaggctgagagaggttatgttgacttgtcctaagtcactcaccatgtgtgcagaagttttctaagaaaagtcctcaatatgaactcacagacctctgatcaagaatcagggatcttgtgaggttcctgggctccagcctgggatcactagctcacagattgaagttaaagctcccgagtttggcaatagaaggctttcttcatcttgcctattgacttctcacccttttctcattctgatcctcttctcgttgcacctctatacttctgggctatcttgaaactccaagaggacagcaagctctttgacacttttcattaccttcgcttggaagtcttccctctgcctggaatgatcttaccccttcttacctggaaatggactatgtgttcttcaaaatgctcagtggcatctctctagggtgctgttcccaaatacagttgactctggaacaacacaggcttggagtgtgtgcttgaagttcatgtccatttatacttgaattttttcaataaaatttacaccaagtgtgcctgcctcttctgccttcccttccatctcctccacctcttccacttctgccacccaagacagcaggaccaactcctcttcttcttcctgctctttgatttaacgtgaagatgacaaggctgaaaacctttatgatgatccacttccatttaatgagtagtaaatatattttacttatgagtttcttaataaattcttttttctagcttactttattataagcatacagtatataatacatgtaacatataaagtatgtattaattgactatttatgttattggtaaggcttctagtcaacagtaggctattaatagttaagactctgaggagtcaaaaagttacatgtcaaatttcaactgtgtatggggtttgcatccctaatctctgcattgtttaaaggtcagctgtaagttctttgggatcccaccacaccgaagtctcccttctcttctcaaagacatcattatcctcctcacagcctgtgccctggcagccttacagagctgaaccaaccagatccttctcctctcgaggttttaaattaagactctcagagactgcgggaacttgaagtcagaagctatgctgtgataacagctagcacttatttagtgctgacattgtgccggccctgttctgagaccgttgcatatatcaccttatttcaagctcacagcactcctacgcaggatatcgtctccccattttacaggcaagaaagctgacgcacagaaaggaggatgcattctccatggttgtgccaacagtggagcacctgcatgtgaatccagagtccatgccttcagttatgacaccttattgctccagtgattgcaggagaactgggactggggctggtgtaatggcaaaaccacaggcaatctggaaatatacaagatcagaaactgaggagtgggaaaaggagaagctggttcacagtgagtagaacaggccatataggcagacagaagcaaagacaggataaaaaccaaccccaagatgcagagagagtctctgtcctagttggaccaatgccccagccactgctcagccacctgctgtgcatcttatttggagcccaagtctctcatgcaacttttcctttcttttccattgactcgtttttttaaaacctgactcagactgagtgacattttttctttccttatcacctatactaaaaaactccaaccactggaaattcaccagctccgatgtactctaaggccctgctgctatgcatttttgccacacctaaaaggaagctcacctgctgactcaccgagcaataactgggtcctacttacgccgacatttttaagcagaagtgtgcctcgtgcaatacttagaacatatttatactaaaaaattatttgctgtttatttgaaattcaaatttaactggctggtctgtattttatctggtaacccttacctggaattctatgagaaatgcagacacccaggctccaccccagacctaataaaacagaatctgcatttttaacaagatccttgggtgactcatgtgcacaagaaagtttgagaagtctggctaaaagatgaattaaaggcagtccagagacaatacagtagctccttgtccaccagggacccaaacccttcttatctttccattccaatatacttacctcatgctttctacccttaaggtcacttcctggtaaaggttgccagcctaagtctggcctccagatagaagcaaaaagaagatgccaacagacatttcccaaaccccatagaatggcctccactcccatctcattagctgttcctattgcaaggggagctgggagatgtagtttttccgttggacccaggatgcttctgtgacttaagtgtaagtctgtgggattgatattcaacaggaagcaaatctctgccatttcttctccctgagaagaacttggtaaagttaacaagttgtgttcagtttgaccagggggtctgaccaaaccaaagaggcagggaagggcaacaagatgcctgaaataagaagaaagaacaagggagtcctagccgtgttctagacctaggataattatagtactcagctcaacaatagattctatgctttcacagagaagagatattttgggtatattttggctgatgtagaaagctctagcaggcacagataccctaataccatactcgtgttccagagagcaatgactgattgcaggagtactagagttaaaatcttgcaaggtcaaggacaaaacactgttgggtatgctggaccccaaggaagtgcaacttctgttgggatttaggttacaaaggggagtgtggtggaactgcacagaaccagtcttcaacagcgatgtcatgtggctgcaagaagcaatagcaatgacagcgcaatcaaactctagtactctctgctcattgttgaagacacctggttccctttagactacataagccctttaagtgtgaggaccactgaggatggtcctaaatggtgtatcaacatctcgctggtaagaatgttcaaatgtttaattgaaaacaaacatgaggccaggcgctgtggctcatgcctgtaatcccagcactttgggaggcagaagcgggcagatcatgaggtcaggagttcgagaccagcatggccaacatggtgaaactgtctctactaaaaatacaaaaaaattagcctggcctattggcataccaataatcctagctacatgggaggctgcggcaggagaattgcttgaacctggaaggtggaggttgcagtgggctgagatcatgccactgcactccagcctgggtgacagagcaagactgtatcaaaaaaaaaaagaaaagaaaagaaaagaaaactaagatataaatatatttgcactctgagatcaaggagcaaagaaaattatcatggtattagggtgataaagaagatattattggcgaggacaaccttactttcccctcaaatctaaccctccaggtttggttagtccaaacccataactgctcttggatcatctcaaaccagatttctttcaagtaatgccaaactgaattaattctgggtttctagatgtttgttatacaccatgacaaaacccacttccgatgcaagaagtatttttcttcaaatagcagttgagcatggcaagcaagttgtggctggaatcagcctgctccatactgtggggctttattaacaaacagcctttctttaattgacatttctttcaaggcaatttgcagaataaagataaaaattctctgtgccaaattataactcctcctggagggagacacagtggtcccacttattctttcttttgtagggactccagcagacgtgagcctgtaattgtgaaagatggcaagaaatttctgcatcctggcaagggagaggatggccggaatgagaagccacagtgggatgaatttggaggataatccaagcagtgtcagtgagaagagggaggctccagccttgttgcaggtcaactgccaggtgagccaaaaactcaaaaaccaaaccaaaccaaaacaaagctacaaagcaaaaaatgctctctctctttgcctatagaatgaatacttagaagagagaggagaaggagaattaaaaggaaagggatggaaggaagaagagttattggatctaagggactgaaatatatcaacgaattgtgcaaaatccattctaggtgttcaatgtcagttactcatctgttgcatgtggtttcaatttccttttaaatccatatgtatttgaaatgaagccagaccagggtaggatgaaggggagcctgcatctcactgcttccctcaaaacaaagttttggatgtttttggtcattccctctgggttctcagtgcctggtggattccatcgacaatggatgttaaatccatcctctggggaaaggaagtgcttgcagatattgaacgtggacctcagagtctctaatgtgatgagagattgcaaccaactggcttctgccttttaagaggccctgaatccaggccgtctggaaattaaatagggagcccagctcactgctacagcttgtcagtgtgattgccacccacgattggctctgagcatctcttctaaaacatgccagcaactgtgtctttattttgttgatgcaagtccagatgctggtttgaaggaggtaagctttgtttctgagcccctatagcgcactcttcacagcattcagaaagagaaccaatgccttgggtgtgatctccatgaccctgcatgacccaaccccttcatcacctttctgacctcacctccccaacgttccctccattccaacccctctggcctcctcataatcccttgaacatagcagacagtctcccacctcagggtctctgaacttactgtttcctctgcttgaaattctcctcctgcagatacatgcacatcctcagatctcacctcgaaaattaccttccctggcagccctacatttttaaactgcccatggcttcctagctccctggtctactttactttcttcccgcctaagcatttattcctactgaatgcagtatataagttactggtttatcttgtgccttatctgtctgtctctaattacaatgaatgctccatgaaggcagagctttggtctattccattctgtactcaatccccagtgcctaggacagagcctgggatatggcaggcccatcacaaacatgtgttaaatgaactgataaagtaataaacagaaatgtgcatttggcaatttgaaaagctgaaagtgtggcatagtctaagttgggcaatctatggagaattggggctaaagttaactcggtttcatttccataaggaccccctaccccaccctgtacctgttataataggcccacactcgtttacaaggaagccggtgccaggagctccctggggatgggatgcctgtctcctgttaggtggcagcttgaccaaagccacagatggtgccccagggccatttgcatcaacctggcattcaaggccctgcccagcctgacatggatcagcctttatagctatgtttccaatagtcttccattttgtattcattcacccaacaacatgtgtccagttttatcttaaatcattccaatttgcattcaaccccattagatagtcttgcttgggagaatagtaaaagaacatttttgtttttgcaactcttttagctcaactttgtggtcaggaagttccacagattcacgggttcagctttccctctccagggctttctctacatcaagggcccttgagtcaactaagaatgactgagttttctttgatggcatttgttcaacatcacgcaaagcataatcctggagtccagtagaagaagtagtatctagcctgtcatttaacccacaatgcataattggtatatccaccatataaacacattaacacatacccaaatataacacacagatatgcaaaagcaaacacatacaatgtaagaaataaacatgtaaacacacacacaactgtagacacatatgagtcaaacacctgtaaacaaaatttcttgatctaaattcagtgaagctttccatgttgtttagactgtcctggaagataacactgaaaggcaccaacagcttctgcttaagggatgagatgtggattctttaccctaataggtagttcttttcctttttctttccttagaattggctgttttgaccaatcaaactcttggcttggttttgtgttgaaatgatcatagctcaaccttagaccaggctgttctgatatgcccttactttatcaaattgttagctaaggattattatagagattcttttaaggagaagtgtttgcattgggcatgtgctgcgggtatgctgggaaataagtatattctgggctctgctttgagaagcaaaaggtgatcataggtggggaaaaatcaaaggaggaacattctataatcctttttatttttttgatccttgaactccttgaaactgggataaatgttctaagggcagttcccctgatagtacaaaattaccataactgatctcacaaaggaagataaataagaaaacacatttgtttcaagggagccagggagaaggtatctttttaccttctttctctctctagcctgttgtattctccccctgttctagctgtttcttgctggaaacaatctcaaaaaggctttctctatccagtatggaatgatttatcttagtcttggaattctgggataaaatgtgcatatatgcatacatgtgtacacacacacatacgcacatacacacatgggacctaaagtttcaggaaaggtttttattttattttttaaatgaaaagcaatgtgacactactttcaaactggtttataagaggcacatcaatccagttgtgaactgagaactttttaagggaaggagaaattgttcccgttaagccctaaaacagtattctttcccattgatcatctaaaccaatttgctttatattgaatagctgtattaggaaaaaaaagtcagctgttgataccctccaatgtcagctagatggatttttttccctcaacataaggtgcagttgtagttttcctcaatctcataattaaaaaaaggtgataagctatttgttctgaatcaattcacttagattttaaggagcataatggaacgtctgttgttcctgaaataaacagcacaatctcgagtactcagacagcttgcctaaggtggtaggaatactatgtttttgtcctaccaaggttctttacccggggctccctgacccagaagacctgtgcataaaattcagggctgtgtgacttggatggggaaaatgtgcatatcagttttaactaatttccacctcaaatgcagcgtttcagttaattatgaatataagcaaaattgacagcaatattaatgactttgcacctatggtaaccacagatagtttatgttagattacagacttcttttgtaaaatcggatatagtctatttcacatgcatttagaaacatcattttaagaagggggtccttgggcttcctcagactgcaaaagtcaccatgaccctgtaagtgttaagaccccttctccaggagacctgggtcattagtaaaggtcatgatccagcacaggctgtgaaggtgcatggcatcccatcaccaggaaactctttttttgtcgggggccttgaaccttctcactcatccagcaaaatgctcactctaatgccccagggtggaatctgtcattactgtatgtatttaagcttcttcagattagcggcagaggtgaaggagaaagaggaaaaagagatcacataccactcctccatctcttcacatattttaatttaaatatggaatcatactctatgtcagtattttgtaaacttttcttttctgtttttgaaacagggtcttgctctgttgcccaagctggagtgcagtggtgcaatcatagctcacagcaacctctctctcccaggttcaaggggtcctcttacctcagcctcccaagtagctgggacaacagacgtgtgccatcacatccagctaatatttgtatgattatgattatgatttctttatagagatggggactcatcaggctggtctcaaactcctgggctcaagtgatcctcccacctaggcctcccaaagtgttgggattagaggagtgagccaccacgcccagcctgaaatctttttcttcctaattttttaattttttgagacagagtctccctctgttgcccaggctggagtgcagtggtgtgatcttgactcactgcaacctccacctcctgggttcaagccattctcctgcctcagcctcccgaatagctgggattacagttacgcaccactatgcctggctaatttttatatttttactagagacagggtttcaccatgttggccaggatggtctcaaactcctgacttcaagtgatctgcccacctcagcctcccaaagtgttgggattataggtgtgagccactgtgcccagcctgtaatctttttcttcttaatattttgatagcacaccttgatggagctctttctgtgtcccaagcaacattctaagcgcttggcctgtgttatctcatttccttctcacaaccactcttggcagggggtactcttctgacctctcataaatgttggctaaatgaataatagctgtctcttattgaagacttaccatgtgccaggagctattctcagagttctgtacatggtctcatctattcttccccaaagcccacagctaggttttattatttttacattttatagataagggaactgaggcacagagagattaagcaccttgcccaagatcacacagctggtaggtcaccagtagaaacctctggatatcagtggagacagtctgactgcagagaggtgttgttaaccagcaggcagtcccaccctctatgatgaacttttgtcatggtgattgtttgagcatgctttagtttgtaaggttgccacatcattcctggaataggagatagctttttctttcgcatagatggatactgaaatcactctatatcagtattttgaaaaattttggtgactctaccctcaccatagcatcatttcttgagaaaaagaagagaaataaacgaagcagcagcacgagcagtttctcttcctactggtctgtaatctggccacgactttaggctgtggctgaaattcctgaccttaaattccagcagcctctgattgagggcacccactcagtcaagctcccttcttggaaacagtcaaacgccatctagtgactgaatgcagaatcgcatactcctttcagccaggaagggagaccatggagggggagccaggctgggtcaggaagaggaaaccctctctgggctggtaaagttgaaagcaaggaaatcactgagccccgaggaactgcaccagcatctggataaaaacccttcagtcttcactgtgaacacatctggttagttgatgaaactgttttcacagtacatctggctggatagatacaaccacacagccaccaccacaggctcgtattaactgagcagtttcttcccagcaaaactaactgcctggaaaaaaaacgcatgaacaaaacatatttgtaatttgtcaaatctaaataataccaatagctcagcgatttgctcttttgatcaagactgttttatgctaggaagtgtgctaagtgttttacatacagtgtctcgtctgctctttttttcttaacagctctgagagctagagattaaattattcctgtgatcaaactggagctcaggaaagctaagacattgtccaggttcccacagatggtgtgtgacagagctgggagctgaatgcagatcttgctgactccaaagctcagactccaaagctctgactccaaagcgcacgcaccacacacacacacacacacacacacacacatttaaagatgcagaatctcattatttagctaagctaccctccgtgcagcaaatatatcatcacagtgaaagtctagtgatagtactataaagacaaattatatgtaggcaggaaagagaaggctaatatccattattatcgttacagtggatttttggaggatttgacttttatcaaaaatattgttttaaatcaacaaataccaggaaattgaatccaacagcatattaaaaggatgatatgtcataaccaagtgggatttattctaggaatgcaagggtggttcaacataagaaaatcaatcaatctaatatgtcacattaataaaataaacaaaaaatatataatcatctcaattgatataaaaaagggcatttgaagaaatacaacaccctttcaggataaaaatactcagaaaagatagaatagaagggaacttcctcaacatgataaaggacatttattttaaaaaacccacagctgacattgcacctaaaggtgaaagactaaaagctttccccctaagatcaggaacaagacaagaatgcctcctttcaccaatggtattcaacactgcactggaaattctatccagcgtaattaaacaagaaaaagaaataaaaggcatctaaattggaaagtaagaagtagaactatctctgttcacagacggcatgatcctatatatagaaaatcccaaagaatctataaaaaagccattagagctaatgaacaattcagcaaagttgcaagttacaagataaacatacaaaacccagttatgtttctacacacctgtaatgaacaatccaaaaaggaaattaagggagcaatctcatttacaacagcatctaaaagaataaaatgcctggcaacaaatttatccaaggaagtaaaggacttgtacactgaaaactcaaaacattgcagaaataaattaaagaagacttaaataaatggaagaacatccagtgttcatggattggaagatgcaatattgttaaactgtcaatacactgaaagtaatctacagattgaatgcaatgcctattaaaattgcaatggcctctttttttctgtggaaatggaaaagctagtcctcaaatccacatgggattacaagagaccctgagtaactaaaacaatcttaaaaaaagacgaaaaaagttgaagaactcacactttcctgtttcaaaacttactacaaatctgtagtaatcaaaacagcatgatactgacataaggataaacatatagaaaagtggaataaaaatgagagtccagatatatacatatatttctattatttatatatatctcatatatatgtatctcctatatatatatctcctatatatatatctcctatatatatctcctatatatatatctcctatatatctctcctatatatatctcctatatatatatctctcctatatatatctcctatatatatatctcctatatatatatctcctatatatatctcctatatatatatctcctatatatatctcctatatatatatctcctatatatatatctcctatatgtatatctcctatatatatgtctcctatatatatatatatatatatctccaattgatttttggcaagtgtgctaagtttgttcagtcattcagtggaggaaaaaatagtctcagttggtgagggaacaactgaatttccacatgcacaaaaatgaatttggatccctacctcacaccatatgaagaatgaactcaaaatagatcagtgacctagattcaaaagctaaaatcataaaactcttggaagaaaacagaggtaaatctttatgattttggatttggcaatggattcttagacatgataccaaaagcactagcaaaaaaaaaggaaaaataaagataaatgtgtatatgtgtgcatgcatgtgtttgtgggtgtgtttgcttagtccagaattagggtagtagtaacaatgaggacaataacttcttagagcaccttcattcaggagttgaatcacagttcagttatcagacaatgccaggaagagctatacatttcttttggtatattgacatcttaatattattaagtcttccagcccatgaatacaggatgtttttccatttatttaggatactgaaacaggaaagaagaacagagctattcgtgatcatacagctaacaaatggaaaaatgacaattggaaatcaggtttttaaactcaaagttcatttctctctcccaaggagtgctaggacaattactcatttgtaatttgtgacaattcaggcaagggctgatctctagtttcccctgctcttgggaaaattttctcaaagatgctgtgaacacagtggggaaaaggttgcaaagagaatgcttaaactgcttataaccaaattgcttttaagcagcactttagtagaatccatttatataataagaatgaatatgctaactgtgagccatttttgtgtatccttgagggatctctacaggacaagcctcatttgaattattctcttcctttagtaaacatccagtacctgggatttactgatttttggcactgagtctgaattgctgagatttattttttttgtaaagatgaaattattaaagtagaatgaggatggaactatcatttactgaacacctagtaggtgttaggatgcatccttaccatccttgagtcctctaagctccaggaaaagaagcctttgtaccaggcaaagaagcctttgttctcagctcatacctaacataaaggaggattcacctcttcagaagattaccctccactgaagacacacaaattccccaatgtaataataagaaatggatattgtactgcaatcttatggtactgaagggaggttttacatcacacaccacgcaacataaacatctcctttaaaacttcttgtttttaatcctcaaatcttttctttttgccagtggcttcattattcactctcctcttacccaaaagagcatcacaaagaaatgtttcctattggcctgagcaattcaatggtggtgcccctagattgtaaacaaccctcaggagaggaaaaagtccggttgttaattaaacagatgatcaaaattgtttttgtagggtgtgtatgcatgtgcatgtgcctgtatgtgtgtgctgggtggttctcatttcatctgggttcacttttgttaccttctttgctctttaaaacaaccccaagagatcatttagtcccattttgtagaagaaaagattgctgcacagaatgatttggtaccacgtctaaggttgcacagtttgtcagtaggggaagccacagtgccatacagacctgattctagtattcatgatgccagaaactggtcccagaaatgaaaggctgtggctttctcgattttcatagcagtgggtaaattcttctttctaccacaatggaccttcttcaacgggccctgagtaagtggtggccaactatgtattagggtattcaagaaatgtatagtctaaagcaggacttagcaaactacaactagtgtgccagacccagcatgccacaggtaaataaagtttcactggctcacattaggcccataactttagatagtgtctctggctgctcttgcactataagggcagtgttgagtagctgcaacagtgatccaatggcctcaaagcctacagtgttttactatctagaccttagtgaaagaaggatgccaatccttggtctagagagtcaactgacagataagttggaaattgaaaatcagagcttaagtaggtggtaggggagcacaggaaccatgtaattgccaacaggtagactttgtttaaaaaccactcacagtaatcagcatccttccatctcccaattctccatattgttattaggaccttgaaaataaccaattaataaatcactatatattaattacttgctgtatgccatgctctgtcatatgtgctgtggatagagctatgagcaaaacaaaataaaaaatgagtgtggaatataggaggaacagaaagaaggctattaattgcttaattgatgttactgagagcctggagctcaataccagatgagactgcgagggagggaggcaggggccaggatgtggaagactgtgggattttattccaggtaaaacggtaagccactgagaaattctaggcaaagtggaggttgtcattatcatatttaatatgatcactctaactgctctatgaagattgaataattggaaggtgaggatgggagcatggagaataaggaggaggttactgcagttatttaggcaagacgtggaagtagcttgactagcctgataacagcagagacagagagaactgtttagatttagaatatgtttagggttagagctaagaggactcatggatcatgaggatgcatcttaaaaaagaagctcaaagcttgcttccaaaagaaccaaggagaacgtcgcaaattgtaagatttattatgattctcacctgcccacacaggcagggctgaggcagcttgcagtgcccacccaggtcctctggtgtagaggcagccatttttgctctggacagacttgtcctggggcctgtgcaccaccgctgcagaaacgggcagatgcagcctcaaaataaatgaatctccttgtgccaggtagctggcctcctcataaaaggatggattggactggttagagagatctcgacacttgtgttgcagatccattaacgtcagccacacgttaattctgagcaatttccaggtgatccaataattcattaaactgacaaaaacaaatctttggaaaaccaagctggtgacagatagaaagccaatgatttattgtctggagaggaataagtgtcttcctttccattcttcagtctgttgagtggatcgaagtgtgcagtaagaacaaggtaggtgtgagttctacttaatgggcattgttcaggcccaatgtggcattcatgtcacactgcttgcttcataaagtatttgggggaaggaagtataatgtagcaggaagacctggacactgaggttgggtaaaactgagtttgacttcctcctctgccagttattagcttctgtgaccttgggaaagtcactccacctttctgagcctccactggttcatctcttcaactggggtaataatatattttctcctgtactcatgtctgcatataataaatgaatatgatgaagtacagtgcctagaacattataggatactcaatgaatagctaacgttattgttatttgtgataacaaagaagatgggtgagctttttttcctttggtgtgtatattagttcattctcacagtgctataaagacatacctgagactgggtaatttacaaagaaaagatatttaattagctcatgattctgcaaggtgtacaggcttctggttctaaggaggcctcaggaaacttataatcatggcagacagtaaagggaagtaggcacatattcacatggccggcagaagagagagagagaaaggggaagtgctacacactttcaaacaacagatctcgtgagaactccgtcatgagacagcactagagggatgatgctaagccattagaaaccacccccatgatacaatcacctcccaccaggccccacctccaacactgtgaatcacaattcaacatgagatttgggtggggacacaaagccaaaccatatcaatgtacatacatcaatgtgagcctacaacaaggcattgtctgtattcatactgatgctgcaagaatgttatagaatacttgcctagacatgcaaagagaggagacatccaagacagcactttttttccaaggcagagtctgagaaaaaatgggaaatcagaagactaagaatatgagtgataggatttggggggtgctggtgaataggaataaaagggccctaggcttaaatagaagaattaaaggaggacagcttgggaacttacttccaagcagcagcggagaggatgagtcatgtgaagaacagaataatacttagaaaatgatgctgcaattggtttgaagtctggatggagaaggtgacttctgaacttagacctgcaatatgtcaggtgtggaggagacctcagacaccaaatggaagaactgattttctttaaactcttgtacttttggctgttcactatccttttcatcatctggtaatagcatttctgtattccctaagggcccacccctcaaaggtgcatacgtatctcattttctgtatcctttcagcttttatttatgggagctctatcacagctatagcaattctggacagaaattgtgattttctcagctgaaaatacctaaaagccacaaagatgcctgaaagggatgaattaccatggattactgttctcataaatagattcctggtctaactaaatgcatttaggggagtatctgttggaaatccattagacaaggcttagttggagcccatggaccctaagaacctccaagaggaactttgaactttggcacccccaaagtgtgtatgagaagcctttaacttggcctgtcttctaaagattgaaaatgagtttgaaatcataggaggcctgggaatgcttaaagtataacttgcccaccattggaggtatgctcccaagtattcaccagttctttctgtaagagaatcatacaactctccactattgtaatggggcttgggctgctttctgaggggggagtagactttttgacccactgatgtcaggtttgtccctgtgacttgttttagccaatggcatatgagtcaatgtactgcaaaccaagttcaagcagaagttttataattgtatgtttttatcagccctctttctctttccctctgacccatgaatgccatgtctttgatagaggaagttgcttcaatctggatcctggaatcagaagatgtatggagcagaactgcagctgagctgtgactaccagcataggataaagagagaaaaaaacctaagttgttgtaagctgctgaaattttggggatgcttgttacacagtgtcatctagcaaaaactaactgacataggaagtgagagcagccactaactcaaaagctggtcattaaacattataacagcagccagagatttttttgaatgctaactcttccaacttaatcccgtgatatattagccctgctctttccgctgattcaagagtttgacggctcaatggatctgatctttgcagtctaagtgcatgtgaagagtgtgtgtgtgtgtctgttgtgtgtgcatgtgtgaagcttctcacgttgtgcccaagtcagaaggacacatgttcctgcttaaagcttggatgactccatctttaagagttgtgcttcccaaagtaattatacgtagtcagatgttcatcattcaggggctgattattccacctctttctttctcagtatggatttgaatcatctcatgtacatcacagctgaagacaatagtgactgcaagaaactaaaggcaaagcccaaagtcactcacttgcctattgactagtcactgtcagaagggaacaacaattacatgccaagcactgtctaggtgctgaacatacatgattgaatgtaatttttatggcaattcataagtatcattgttcccattttacagatgatgaaactgaggctcagagatattaagcctcttgcccagaatcatataacttgcaggtagagttggaatagagcataaggtatttgtctatgtttttcctgactttagtcaatacaaaaaaacttaatttaaatggtagataatgtcaaataagatgaaaacaacatctatataccatttagaagtatttgggctgaggagttcctgtataataatgtgatagaaaaatggaagctaagaggcaaactcacagtcttgagatcacagagagaaagaacaagaaaaaccaacactgaggaccagcccttttgtccactgtgcctaaataggctccctggaagatcttgcagaatgtggtagcaatggagggtgagaagactctatttctattttaggagatttctcctttcgctcaaagtaaaaaagcaacagcttttgtttaaacccctaaacaaactgtttattctcttacctcatgcaaggagaaactgagaaatgcatgacggtgcactttgagtggtaatattgtcctcagcccatgttattagtgatgcaatggaggtacttaccactgacatacatttgtgataatttataagactggttagctcacacattgcatttgaactcttgcctgtctagagagtttcttgaatataaagcaatcacctaacttgaagccaaagtaagagtgaaagaaatcccagaatagtctaggtttggcaagtgctgatggattacttagttctgtggttctcaacaagggggaattttgcacccacaaggcaatgtctggagacatttatgtttattacaactgggtggagcggggaaagtcactactggcagctagtgggtagaggccagggatgccgctgaacaccctacaatggacaggacagccctcctcgacagaaaattgtctgctccaaaatgtcggtagtgctgaggttgagaaatccagactacctcaatgctcctgctttgaccaacatccagaggcaaaaagtggcttactcaatatcacacagcaagttagtgcaagatctgggcagcagaataatctgcaattgttagaagcacaggctctggaatctgaatgttcggctctggaatctgaatgtttggctttggaatatgaatgtttggctccaaatcttgggtttgattcttactaactgaggaaccttgagcaagtcacttaggctgtctgagcctcaggtagctcatccagaaaatagggagaataatggcacccatcacaaggtctttgaagaggatccaatgagataaagcacataaaggacttggcatagagtgtatgtacagtatgttttccatttatcattagaattctgtactttcttagcaggattcaggtaagaaattaattttaatttcactaatataggaaaagaaatttctaattaaacattgtcagctttttctatgtcctgttagaggagaaatctctgaatcactaaagaccaattcaatgatctctttagtctcatgaatgtaatccaaggaggcgccactaggtatgaagaaagggtgcatgcagcagaacacaaacatttttctcctttagtttgataagctcaacactgctatgcactattataaagtgatagagggtgtagtacgctgattaatgacccttctttgatctcatccccaaagatatccaagttctaatccgtagatccagtgactgttctcttatatggaaaaggggactttgaagctgtgattaagttaaggatccagagagagagagagagagagagagagagagagattatcttgaattatctgggttggctctaaacgttatcacaaggatccttgtaagaggaagccaagatggtcagaggaggaacaaggtgaagtgaccatggaagcaggggggggaatggtgatgtgatgtgtagccatgagccaaggattgaggatagcttctagcagctggagagggcagggaggcagatcttcccctagagcttccagaaggagccagacctaccaataccttgactttagattcatttgggacttctgaccttcagaacagtaagagaagaggtttgcttgaagccaccacatttgcagtaagtttttaatttgttaacagcagcaataggtaactattacagagggttattcattgcggggaatggagggcacatttacacagggggctgagtccctttctggggagaaaggaattgagatgctgaccccattcattgttgaggttcaaggttatccgatatctctgctgactcatgtggctgtgactgaggtcagccggcagcacaaaccatgagggacaaaagagggggactcaccgcagtggaagagacagctggacttgggacacaagaggagactaaggcttaggttgtcctgggagggaggctggtcctggagagtgtgaggccatggttgagacctttctagaaacatgactccagatgcaagttaggaaccatggcctgttatgatgaaaaatctggaacagacattgtcttaagatggggagagatgaccataagtgacagacctgagaaaccacagcatcagttttgggtcaatgcacagtggaagtacagggtgctgttgtgatggacagatttgaaccgcagcatcctgggggcagcgttatagtgagagggagagaaaacagaagcaccaaggattttagcaagttatcaggctaaactgaggaaaacagcaccccctcctgctacaaccatagatggacatgacattgtaaacccatcaaaatacccagcaagggctggatgtggtggctcacatctgtaatcccagcattttgggaggctgagatgggtggatcacctaaggtcaggagtttgagaccagcctgaccaacctggtgaaaccctgcctctactaaatataaaaaattagccaggggtggtggtacatgcctgtaatcccagctacttgggagactgaggcaggagaatggcttgaactcaggaagcagaggttgcagtgagccaaactcgtgccatggcactccagcctgggcaacaagagcaaaactctgtctcaaaaaacaaaacaaaaaaaaccagaaaagcctgaaagtcagtgaaggaactcctcaggggccagagatgacagccaggctgtagtggtggtatgtaagtttcagagatctgattatgggccaggagactgcagtatggggttcaaacacagaaatgggaagtgaattcaggctcgcaaaaggcagagaactggggcaactctccctaaaatctagagcagtggctctccttaggttagtactgtcagaggcatttgaaccagagtgaccccatcttgaataagggctgggtaaaataagactgagacttactgggttgcatgaccaggaagttaggcattcttagtcacagggtgagatggaagatctgcgcaagatacaggtcacaaaagccccgttgacaaaacaagatgcagtaaagaagccagcctaaagccaccaaaaccaaggtggtgatgaaagtgacatttgggcatcctccctgctcattatatgctaattcgaatgcattagcatgctaagagacactcccaccagtgccacgacagcttacagacgtcatggcaatgtccagaagttaccctatgtggtctaaaaaagggaggaaccctcagttctgggaactccgcacccctttcccagaagacacatgaataatctactccttgtttagcacataatcaagagagaactgtcagtatactcagtcacgcagcccataccactgctctgcctatgaagtagccattcttttgtttctttacttttctaataaacttgctttcactttactctgtggactcccactgaattctttcttgcgtgagatccaagaactctctcttggggtcttgactgggagccctttccattaacagtactgcctcctagggggacatttggggaggtgggggtgggcgtgttttttatgtttctgttatgatggcaggaggcaccagtagcatttagttggtaggagccaggataccagacatctggtaatgcccagggcagtctgactcaaacaaaaaactcctgccagcctgtgcagagttcaaatgcccgctgagaatttgcataggcaaaaaaatccattcattactctaagcctattgctatctaggtgaactcttctacacataaacgtaagactttttttttttcacttttaatacacactaaaattttcagaaatttcaatacgatgaaaatcaaggcaagctggtactttatatgtttgggaccacaggaagagtggttcactatcttggaaaatcacgttacccatggcaacaccggtcctggtgtttgcatcaccctatctgcccccatttccgcctgtgttcgtagttgtcacagctgtggtgattctacactcaggttcatgcattttattattccattaagtctcattgtgcctcagcagttactcgccctgatgccctgataccgcgtatgtgagttaggaaccatgggtctctggtggatgaaaaatacatatgataataaattagttttcaatttttaatataacatggcatttttaaatagttacgagtaggttctattagctgtgattttcatttcaaaacagtaaggaagatattacaaattgtttactagaaaaacagccattggatcaggtcagattgaaagtcattggcctggcatctccaagagctgtcccatccattgcagaggaaagggaaagattctgccagccagcctgggggaactgcaaggaggctgtctgtctattgtctgtctgagtcctctggatgcaagagaagaaaaatgtcacctgtgaataaatcaacccctgatcactggtggcctctgcagggtagaggttccacagtctgggaaatgaacacagccactgttgaatgaagtcaaaaagtcacggtcagcaagctgggaacagagagaggcaggtagacttggtaaccacagagcttagtgaccctccatggggctgtcagcgtgctggaagagttggagaggcagggagctctctcatagaaacttcttggcagccctgtagtcatccaacagagaatttcaaaagctcaggggaaaggcacagaaatcagtaattcatgataacccaaccctgggatgcaaaagaagttgtagttataaattcacttcctagtaagggggcaggttgcgaggttcactaatcctcatttgcttcatctgcagaagaggcaaaagaacatcaactttgtcaagaccggagactcttgactggaggagactttcccaaggacattctgtcatgtctggagatattgttgattactgcggagatgggggtggaggggttgctactgacatctggagaggagaggccagggatgtcgctgaacaccctacaatgcacaggacagacccacaataaagaattctttgtttcccaaatgtcaggagggctgacattgagaaagcctggaggaaagaacaaaggtcatgaaatgatgcttaaaaagagctggcatgactcctggctccttatgggggctcaggaaatatgactgccctgctggagtctaagcatccacgggtgttgctattttcagacctggaagtaagggaacaccgtcaccattgattgcattaattgctacagatatcatcaccattgtccttgttgtgattattactaatggctggtatttactgagaccttgcttagtgaggtcctgttctctgtgcttttcatgttgtgattcacaactctgtgaggtatatgaggtagttcttattattacctttattttgcatagaaggtagttgagtgcctatataagaggagctgaccacaggcagtacactcgtatgtcaaccattttcacagggtcttttatttgtaatcaatcaattaattaattttccattagtgagtatagttgacaaatacaattgtataagtttaggtgtttggtacaatgatttgatatacattgtgaaatgattatcacaattaagatagttaacacagctgtcacctcacttacatttttttctttggcaagaacatttaagatctaccccttaagcaaatttcaagcatacgatacggtgttgttaactatagtcaccatgctgtacatgaaatccccagaacttattcatctttccactaaaactttgtaccctttgaccaacatctccctgttttcttctcccccgattcctgccaaccactcttctactctcggtttctgagtttggctatttttgatcccacatgtaactgagatcatacagtatttatctttctctgacttatttcacttagcataatgccctcaagtttcatccatgttgttgcaaatggcagaatttccttcttttttttatggctgagtaacacccactgacgggcactgaggctgtttgtatgtcttgactattgtggataatgctgcagagaacatgggagtacagatagctccatcagcgatggattttgtttcctttgagtaaattcccagtagttggatttctggatcatatggttatttttaatttttgagaaacctccattttccataatgactctaccaatttacattcccaccaacagtacccaagggttcccttttctccacatcctcaccaactcttgctatttttttttttttttttttgataatagctattctaacaggtgtaagatgacatctcattgccgtattgatttgtagttccttggtgattagagatgttgggcaccttttccatgtatctgttgaccagttgtatgttttctttggaaaaagtctctaaaaacccttgactcattttttaattggatttgtgtttgtccggttttggttttcaccattcagttgtatgaattccttatatatttcagaaatttaccccttaccagatatatggtttgcaaatattttctcccattccataaattatcttttaattttattgattgtttcttccgctgtgcagaagatttttagtttgatgtagccctacttgtttttgtttttgttgcttgtgcttttagcgttacatccaaaacatcattgccaagatcagtgtcaagaaggctttcccctatgttttctttcagaagttttacagcttatggttttaagtatttaatccatttagagttaatttttgtgagtgatggaagatagggtacttagttttgttctttttttcatagggatcttctgtttttgcaacaccatttattgaagaaaactatctttcctagttgtgtatttttggcagattcgtccaatattaatcgactatttatgcataggtttattactggactcttgtttttcttttcttttgttttttttttgagacagagtcttgctctgtgaccaggctggagtgcagtggcatgatctcggcttactgcaaactctgcctcctgggttcaagcgattcttgtccctcagcctcctgagtagctgggattacaggcatgcgccaccatacccagctaatttttgtatttttagtagagacagcatttcaccatgttggccagggtggtctcaatctcccgatctcgtgatccgcccacctcagccttccaaagtgctgggattacaggagtgagccactgcgcccggtcctgggctcttgtttccattccattggtctctaggtctgtttttatgccagcaccatactgttttgcttactgtagttaggtaatatatgttgaaatcaggaagtggatgcttccaactttgttcttctttctcaagatttctttggctattcagagttgtctgtggctccaaacaaattttaagatttttttttaaaaattacatgaaaagatgctattggaatattgctaggatttcattgactctataaattactttgggtaatatgaacattttaataatattaattcttctgttccgtgaacacaagatatcattccatttatttgtgtcttcttcaatttctttcatctatgtcttatagttttcagcatacagatgttttaccttcttggttaaatttatccctaagtattgtattgtttttgatgctattgtaaataggattgttttatttctttttcagggagttcactgttagtctctagaaatgcaactgatttttgtatgttgatttcatatcttgcaacttgacagaatttcttgttgttgacaaactgagattctagattgcctgtcttaaacttctttagtttctctagaatgtctagcacataactggaaaatagaaaaggagagaaactaaacatttatttggttccaagcacatatttgtgtatatacatatatttgtttccagttgattctcattatttgcagatactgtattggtgattttgcctattcacaaaaatttattcataatcccaaaatcagtacctgctgtgcttttgcagtcattcccaggcatgtgcagagttgcaaaaaagttgagttacccattgtgtttatcccacctgagacccaacaaggccagaatctgctttctcggttctactctcatactataaatgagtatgcatcttgaagtttacttagcgctatgcttttcatacttttgtgccttttgctggtggtttttgctgtttaaaatggtccccaagcctagtgttaaagggctatctagagttcctaagctcaaaaattctgaatgaatgagagtttgcatagataacagtaatgttaactccttcaagaccaaggtttctcaaggtttctttgtttggtaccatgtcaaacaaagatgcaaagtgttgcactttgtgatgtggtttatggagaaaaatatatatttgttagataagcttcgttcaggcatgaggtatagtgctgttggttgtgcattcaatgttaatgaatcaatatatattaaataaggtgtctttacacagaaatatataaaacaaagttatgtattgatcagttgatggaaatgtcatgactggaggctcaaaagaaccaaacctatatttccccccaggagtaatggttcagtatttaataacttagtggttgtggagacattattgaacctaatcatagcaaataataagaatatacacacagaaacacacaccacacacacacacacacacacacacacacacacacacacacacttttttgatctcattttgtatttccagccacctgtaaggtaggtactattatggccacttgacagatgaggacactgagggtctgggaagccaggcagtttgccaatgatcacaaagacccagaaaccaaacccagtttagccagaattaatcttccatgctctttctagagaatgtcaactttttttcttttcttttcttttttttttttttttttttgagacagggtctcactctgtccccaaggctggaatgcagtggcaggatcatggctcactgcagcctcaacttcccaaggctcaggtgatcctcctgcctcagcctcccaagtagctgggaccacagccatgtgccacgatactaggctaattttttaattttttttttttttttttttttttttacagatgggttctcactatgttgcccaggttggtctcaacctcctgggttcaagcatttcacccacctcggcctcccaaagtgctggcattacaggtgtgagccaccatgcccagcccagaatttcaatatttgatgattgaatcaagtcatgttaaacatgcaaaagtacttgcatttttaattagttttttttttcttgtttccttctcttcccaactcaggaagaggtagagtccagggtggatcagcacaagcaaaagacacttccaaggactgtttctaaaacccactttactacatcccaaaacaggacaaatctcatgctagcgactttggggaagcaagtataagtttaaatacacctttctaacctaaaagacagtgaatcttaaatcactacaatatccacattttaacctttttattgatttctttgttttagtctgtaagacagtttttttcttattttttaggttagctagactcttttataatcttttagtttgtgattttaatgtttttgtttgctttgttttgagaactgaatgacttcttacactgtcttttttatcttcatctgttcggatcataaaaatggtctataagcctagatcctccagtgagaagaagctccatctaaagatgctggatctgtgcactgccacaggaaacattataaagatcaggtcatgtgatccacaagtcagctgtgaacactcttctgttctcttaaaatcgactcaagcccccagtttcatactcagctggaaaatttaatctctgctccaacatttctgctgatttcagcatcttatattcttacaattacctctaattctaatttattgttaatttcgccaaaacttcactctggggatgccaacagagatatggatgtcagaaactttttttcaattttctgagtccagaatttacaaaaggcatttacttaggtatgaaacagtcttaaaggaagatttgaggtgatgaacgacttctacccagcccacaacttgaaaattgatttttaggcacacgtgatcttaaaaatccttcagctatttctatttatgatttttttttaattgaccattcctgccccttttgcaggatgctttcctatgacttttccctattcctctccctatttctcccaagccaaattttctggggtacatccctggtcactaattctttgtattattttccttacattttggaagcttattattaaggtatttttcttaaaaaaagaaaaaccagaatcacctaagaagtatttttatcctagctataaaaataacattttcacctcttttctacggagtggaagctccttagaagagaggattcgaatgagtttaccagggatttaaagaatcaagactacggaggtgaggccaaaaataccagcatatgaatagcaattgtactttgcatctttgtctttatttgacaagatgccaaagaaaccttgagaaacctcagtctagaaagagttagcattactctgatctatgcacactctcattcattcatgcatgctttaagcaaatagttgttgaggtcaaactgttgtcaaacactcttttaggtgttggaaatagagtagcaaacaagagggacactttctcactggctgtttacttttgtaaggagaatgtaactcactcaatttctagtctcaaatgctgtcactttcaaacaaagatggccaaaatcaacagaaaatgtgatggtgtgcattaaccagcccatttttgctgtgtgagttctcaccatttcctgggcacatggaacagattctagttgagaaaacattccccttcattccgaatagaaatattaactctaataattactaatacttatgtagtgtttgctttatgagtgttttacattatttcactgcattatttaactcacttagtcttcaccacaagccaaagaggcaggcattatttttaccccattttatggatgagaaaactgaggcagagaagtcacccaagatagttacaaaccaagacaatttggctccagaatttatgtccttaactgccatgctattcagcctctctatgattttcacaaatagcaatgccaggtgactgctgcgttcagtgatccaacacagaattatcagagcaccaacgtcatgggttaaaatcttgcaaaatcctgttcacaaaagcaaagacttggaaccaacacaaatgcccatcaatgataggctggataaagaaaatgtggcacatatacaccttggaatactatgcagccataaaaaaggatgagttcatgtcctttgcaaggacatggatgagcctggaaaccatcattctcagcaaactaacataagaacagaaaaccaaacaccgcatgttctcactcataagtgggagttgaacaatgagaacacatggacacagcgaggggaacatcgcatacaggggcctgtcaaggggtggggggctaggggagggatagcattaggaaaaatacctaatgtaggtgacgggttgatgggtgcagcaaaccaccatggcatgtgtatacctacgtaacaaacctgcacgttctgcacatgtatcccagaacttaaagtataataaaaaaatttaaaaaaaatcttgcaaaatccttcaagtgtcagcctgaacaccactttcagagagcagtcttgtccagctctcatgcttggatcattcctgttatcacacattctcacttcatcacatgctccttggtgacctgtactgtaatcaataagtaattatttgtgtaattacttcatctctgtctcctcagctaaaatgcaatctccatgagaacagggatcatgtccctcttgttagccaccctatctccaatacctacaagagtgtttgacacatggtttggcctcaacaactatttgaatgaatgaatggatgcaaacatgaatgaatgagagtatgcatagatcagagtaatgctaactccttccagaccagggtttctcaacctggacgctattgacatttcaggccagagaattttttgttgtgagagctgttgtgtacactgtagaatgtttagcagtgtcccagcctctacccacaaccccagttgtcacaacccaaactgtccccaacatgcatgactttctgattgaatgagagggtgacagatgaacacaatgatatctcttattctagggaaacagagaatacagcatttttgaaggctgaattttactaataagaccagcttattataaaaatgtacttttgcaaatcacgttctttgggaacaaatataggaaggaaggttttatttaagaacgtagatgtcttatttaataatgacagctatcattgtgaagtacatattataagcctgtgttatgctaagtgttctatatcattatcatttagttcttataacaacttggtgggtcacagaggcccagagaacttagtaacttgaccagtattccatgaatggtaaataggagaactgagattggaacctaggtgggtctagcggatggcaaagcctttgctgtcagccaccacgctaagagtcccttagtgatcttaaagtcttgtttttgcaaacatttctgtatatgctctaaacccccatctatatttatgagaagccatctggaagacaaataggggtgcctccaggtgtcccaggacctgacacttgcagatatgtgctgaataactgaatgattagaaaggtctttcccactccaagtttattaaaattaagttcccattatttatgaaaggatatgtctatttcttatctaattcttgtccacatctaaacaaagaagtttcaccaagtcttcagtcactagagcttctgtagactcatgccttccacacttgccctttaacccaaaaccacttgttaaaatatttctcctaaaaaaaagatagtcccctccctacgaaggcaaattcatagtaaaattcccacctcatatatatacattctttaattaggtagggaatattttccctattttaccaatggggaaaaaatggagctgcacttattagtaaagggatggtccagaatgtttcctaaagcccattaatagatgcatattttttttcagtaaatccttttctgtatttctaatggagactatgaaaatgagatatgaagtctttccctagcaattcaggcaggatgatgccttccgactctttttgtttccttttgggtcatgtctgatgctctgaaattctctacctgcctgactgttgcttcaagacagtgggtgtgagccaaacaaatctatccaaccatttgttacatcccaaaatggtaccagtgagatagaaggccccaggtgatggggccccagatgcagatctgaatattctattctaagaagagcagtggaatagatggcccctatgaggtttttgatggaaaccctgaaaaaacaaatcaaaatataatagctcctgctgtcggtcccctccccctccccccaaaccctagcctggaactgggaggatttgagtgggccacaagaaaacagatggtgtcaccagaagaaaggaacttgttgtctgagagcggcctttcgaggcgtaatatgttctttgagggacgtgtttctcttgtgatggaatcaacgcaggcagaacatgctctctaaagagatcttctctctgagtccaatacttctcaaagaaagaaaaccgtaaaagaatacaaaggcagtgtcaattttctgctctccagctgcaaaaacttgcacttgaatgcgacccaaggatagttttcggaacttgtgcagtgtggctgagtactttttataggttgcaagaatctgtgatatgtttgatacctgtttggatactggcgccccttttggacaacagggtcattggagggagaggctctggcttgctcattttagaatccaagttacactgagcacaagatcgggcaaatacgacgtgcttaaaagggagaaagggtgaaggcagggagagacgccaggtttgtggaatcagtatagaagacagccgcatcaccacccgcttcattgctacttcaacctttaaactaggggtcctaaccttctgttgtggcttggacccctttggcagtcagatggagctcgtggataccttctcagaataacgtattttcaaaaatacatgaaatacgttgcatttcaaagaaactaattacattgaaaaatagttatcaaaatatttaataaaacaaacgtgtgaaatggtaatgaatgagcttttttattaacacattaaataaaaagatccaatggcatgtgtaaagacttcataattatgaaacagcaataagggtaaatgatattttgaaatacctgcagcacttgtaatgtgataattacttgtggtttctactggggacacagtaccagcgacatcaccactgctgtggtttattccgtcactcctaattgaggggcatgccaaatttcagttagatgttcgtgagaatgaagacacattttattttttctctctgagtttatgaccttcctgacttctattggcagatcagggtagaaacctctatggtcaatattggagtgacacaaggaccaattcctcaggccccttctcttcaatgtctgcattccttccttccactctagcttctagtctcctgggttcaaatgtatttgcttatatgctaatgagtcccaactttctggaactctctccagacattcccattgaagagcagctcagcatgaaagtcttttttttgtttgttttttttttttgttactttttttgagacatagttttgttcttgttgcccaggctggagtgcagtggtgcaatcttgactcactgaagcctctgcctcctgggttcaagagattctcctgcctcagcctcccaagtagctgggattacaggtgcccgccaccacacccggctaattttttttttttttttttttttttttttttgcatttttagtacagacgggggtttcgccatgttggccaggctggtcttgagctcctggcctcaggagatctgccctcctcagcctcccaaagtgctgagattacaggcatgagccaccgtgcctggcctgagagtcttgcaggcagctctcttaatccattagagctgctaccgcaaaatatcattaactgggttacttatgaacaacagaaatttattgctcacaattctggaggttgtgaggtccaagatccaggtgtctggtgtctggagagggttcacttcctggtttaccaatcgtggcttcttgctgtgccctcacatggtagaagggacaagagatctctctggggtctcttttataaagacagtcattctattcaccaaaagccactgttactaccacctccaaaggctccacctcctaaaaccatagagatgaagatttcaacatcttaattctggggaaacccaaacattcagatcaaagcagttatctcatcctaaatgtgtccaaatgggtctcagtccccccccctgcatcacacttgtccaactgcagtctcacccatttcagtaaatggggctccatcctcctgggggtgggcaggccaaagaacttggagtctgactctttcctttctctgtctcacctacatccaaactatcagcaagtcttgtcagctctgctttcaaaccgatccacgccccacctctgcttcttgccacctcagggctaccacctcgggggaggccccgctcacccctcacctaaatgattgcagtagcttcttaattatacccctcctcctcttacacctccctaaagtctactctcagcgtagcagccagagtaatctttcaaaaacaaaaggcaaggaatggtggctcacagtggttatctcagcgttttgggaggccaaggtaggatgatcacttgagcccagaagttcaagacctgccagggcaacatggcaagactccatctctatttttaaaaaatataaaaaataagccaggcatggtagcgcatgcctatagtcctggctaccagggaggctgaggcaggaggattgcttgagtctaggagttcaagaccaacacaggcaacatagtaagaccctatctctatttttaaaaaatacaaaaaattagccaggcatagtggcacaagtctgtagtcccagctaccagggagactgaggaaaaggatcacctgagcccaggaatccaaggctacagtgagctgtgattataccattgcactccagcctggacaacagagcaagaccccatctttaaataaataagtaaataaataaataaataaataagtgatacaatctgtgaggtcctctgttccaaactctccaaaaaccttttcttttcaccaagagtaaaattcagtcttctgaccacggactgtgagaatcatataaccctattacctctctgacgttactcaactagctccagctactttgcctccagtaattcttcaaattcaccaagccagttccgactccagggcctttgcccatgctgctcctctgtgggaacactcttcccgcatgcccttcatacccttccagtttttttttttttttttttttttttttttgagacagtgtccctctgtcgcccaggctggagtgcagtggcacaatcttggctcactgcaatctccgcctcccagctccaagcgattctcctgccttagcctcctgagtagctggaattataggcatgcaccatgcccagctaatttttgtattttttttagtagaggtgaggtttcaccatgttggccaggctggtctcgaactcctgacctcaagggatccacgtgcctcagcctcccaaagtgctgggattacaggcgtgagccactggccctggcctcttccagtttttggtcaaataaaatcctatgagtgaagcttcccttaaccaccctatgtaaaataattctactctccatcccggcactcatctttcccagttatcctgcttcatttttcttgaaagcactcatcaccattagatacaccaaacatgtacttgttttattcatttatggtccttccccttgtgttggaatataagtgttatgatggcacagactttgcctagattgtagactgatgtagcactaggacctagagctgggcactcagcaaatatctgttgaggggccgggtgcagtggctgacgcctgtaatcccaacactttgggaggctgaggcaggtggatcacttgaggtcaagagttcgagaccacggcaaaactccgtctctactaaaaattcaaaaattagccaggcgtggttgtggatgcctgtaatcccacctactcaggaggctgaggcaggagaatcacttgagcccgggaggctgaggttgcagtgagctgagatcgtgccactgcactccagtctgggcgacagagtgagactccacctcaaaaaaaaaaaaaaaaagaaaaaagaaaaaaaaaatttgttgagtgaatgaatgaatgaatgaatgaagtggttggcttctcataaaactgcttctttactttaaaaacaccacaggatccactgttagcacatgaagccgccacttcataatgagcacataattagttagatcatcccacattcatgcatgaactaatatgggccatctcatgcctttttactgaaccaaccaaggcagtgacaatggtaatagcatggacctaggctggccctcttcccctcacacctgaggcatgctgtttctcagctgggtagatagatgaggcactatgtttaattgctagtgaaaatattttccattttggtgtgctttcaagtttgcaggtttttttctatacattagatttaatcctctctagtgcctcagaaaaagttgcttattcactcaatatttgcgtaagattttattcatactgtgagcatagcatgttaagttagttacatgtttatctacctcttctgttggtctatgaatttctagaaggaaagaatgtttgtattctcaaggctgagcatagtatctggcagatagcaaatgctgatccaatatttgttgatagtattattatctaatatttactgagttatttcagtgtccttatattaaaatggggatactattaacagcccctttcaagactgctgtgagagtggaaagagttaacctaagtaaaccactgggaacgtgtctggcacagagtaagcattcagtattagtcactgtccctcctgttgatgatgttgtcatttgaacatctatttaatgtactcaagtgctttccttaaaacaattatgtgtgatgataaaccagccataatcatgataacactgaacagttattgagcagctaataaatgccaagtttgaggctactttaaaaatgcatcatccaattttcacagcagccatataagatacatacaattctcaatttagagaaggaggcacagattcagaaaggttaagtcgccttctcgaagtcacatagcaaagaagtggcagaggtgggatttgaacctgagccgctctgactccagggtcctaactactatcttatggtgggtggcattgccttaattctaaaaaagaagaaacagagacatgaagagggcagttaactggatcaaagtcacagagcttacaagcattagagctgagatttgtgatagaagaatttcctctgagccagtgggccagaggtactgtctggggtctggaatgcacttcataagcacaaacagagatggaggagatggtcagatgtctggatcatcccctgagggtgagttaatttcgtgctgttaaatgaatctgaaatttgaaagcatactgaataaaaccacgcattttccctcatcctaatgggacattaaacagctacttacataatgaattatttaactgctgactgataagtgctgtaaggtgcaggggctctgagagttcatggcaggaagtcctgcctgagcctgggtcagaggaaagaaaccacaaaaacaaagatgcacgccttccagcaggaggttatggtaatttgcacaaacctcactccggtggggggcctgagaagaagctgaggcgcaccttccaggggaaacaggcttcggagaattaaatgatctcttgcatctcctctcaatcatatgatgtaattattgggaaatgtcacatgcagctttttttgcagggacaggtgtgtgcgaagaaaggtaggcagggttaatattttttcttctggtttatgagtttcattgattttcctagaaggaaaacccttatttgaccttgttcccacaagcaggtttggcttgggatgagaagtctggcagctgttcaaaggcagatgctcctggcctgaagccccaagggacgtcaagaggcagcgagacaggagcaggaaggtggagacagctctgtgcgcctgcaactctgacttgtctgctccgccacatccagctcatcacccaattgtgcaaatttaactcctaaaactccccccaatcttcccattcctctcagccccattgacagcaccccaacgcaagatgccatcatttcttgaaacagacacttaactcatccctcacactccattcttgtttccttataatatcttctcatctgagccaaaagtgaccttcttaatacataaagacatacatcactgtcacctccatcttctcaaaacccttcagctgcttctcattgcacttgggataaacataaaaaatctttttccaaagttgggcacagcagtatgtgcccgttgtcccagcgaaagtgggaggattgcttgagcttaagagttgaagtccagtctgggcaatacagcaagactatgcttgaggggggatggcggccagagatactgtagacacactgaatttggggatgctatttagttaggattatgcgtggctgtaagttatagaattgcgatcaatggtagtctaaacaatctcttatcttactaacaagaagactggaggcagacaccccaaggttcgttcagcaacttgatcttgtccctaaagaccaagttccattccaatatggacttccatttttagcatatgggctttttatactcatgcttcttgtcccatagttacacggtggctgctgttgctccaggcatcatgactatattcaaagacaagaaggagaaggtaaggagggaaattcaggacattaagaaaggattatatcatttctttctccttatatcaggaaggaaatatttcccaaagttctccagcagatagctgctgctgtttcactggttaaatagtcctatgtggccatccctaaccacagggggagttggaaaattagggatcaagcaaggggaaacaggagtgctatgaatggctcagatcgatcatgattctcattctagggcttgcgtattgtaccctttccccgccctgccccaaatgagattgagattctgtcaggcaggagggctgactatttagtagacaaccaacagtgtctgacagagggtggaaggtgggattgggttttattcaaacaaccaccttctgagtgtgaaaaatggcagctacctcttgacttcagtactgtgaaaactgccacttgttccagctgagcctgcttctcttggctcatacattcccaagaagatgactgtgcagagcggcaagagcttccctgtttctcagaatattctcaagaaataaggctacattaataatttgttttcttggtatgggccattcggttgcaaaacaatattgcagtcatagcacgatacttcccttcctcatttacattcactgttggtttaattatgcttttcagtcagaatacttattaattttatagacctacctgaaaattaaattggataaattccttttgcctgataccttgaagaatgtgtttttccaagctgttgatggggcccgcttcggccccgtgcaattttgttcccctttaagttcatttgcaaataacactgtgttggtttaaagggcattcatcatttctgagcaggagaaacactgcaaactgcagcccaattcggaggaaagtaggaggacaatggagaaaattgccaaatattttattttctcattggagaggggagtcattgagtgaggcataaaatttcccttaggattccatgaatccatcttgctggtgaagagaacactacgtgttactggaaggcatcagcaaagccacagggtaccaaaaggacacagagcagggaccttcccaactgaccagggctaaagcggctcaacgtgagaacagcaggcagtgtatttattcattagacattcactgtgtctcaggcacgatggagctaaaaacgcaattaagacatattacctactctcaagcagcttgaattttcatagcagtagacaggcaaataaaggcacagtgatgataaagtgtgtctatcataaggtagaaaaagcacagaatgctgtgagattccagaagcagtacaacacgcccctagcctgaaagctctatgaggatgggaagtgtatttatgctatgctgtgctgtaactttgctgcctagccccatgcctggcattcagatatttaataattagttgctgaattgaattgaattaaaatcaatccagcctggtggcatgtattatttaggtgtggttagctgctataacaaataaatctccaaatctcaatggctgtaacacagtagaaaaatgcatatgtgtgtgtgtggggtgtgtgtgtgtgtgtgtatttgctttttcttcacaaagatcacatcagatctgagatgatagagggtgtctgtcccaagctgctatttgagaactgaagcttctcccatcctgggtctcttatcatcttctgagtcctcacccccacttaatgaatagagtacaaaacaaaattaaaattctaaggccccccaaccacctgaagagacccctcctttaggccaagggtcaagttaacctgaaaatcaagttcaggccacaatgagaagtgggattgggacatgcctcattacagcttcctcccttttgcaattactgatggaacagactctttaagtctggtaagaaacatttacaatctattctttctgaagccttatacccagtggcttcatctgtctgatataatgttggtctccacaatcccttatgataatccacagccagctagctacctagctagcttgcttgcttgcttgcttgcttccttccttccttccttcctttccttcttcctccctccctccctccttccctttcttctttccttcttactttgagacagagtctcactctgtcatcggggctggacagcactggcgcaatctcagctcactgcaacctctgcctcctgggttcaagggattctcccacctcaggctcctgagtagctgggactgcaggcatgtgccaccacaccaagctaagttttgtatttgtagtagagacagggtttcaccatgttggccaggctgctttcagactcctgacctcaagtgacctgcccaccttggtgtcccaaagcgctgggattacaggcttgagtcacggtgcccagctcacacattcctgtctattgataataacattttcaacgaattgccaatcagcaaatcttttaatctacctatcacttgggagcaccaattcctaccttattacccccagcatttccagttgtcccccctttctggactgtaccaatgtatatctcacatgtattgattaactccttatgtatccctaaaaggtacaaaaccaagatgtggcctgaccaccttgggcagatgttcttgggatcacctgagggctgtgcctgggccattggtctctcatatgtgactcagaataaatcctttcaaatattttacagtttgactcttcgtcaacaaaaggaaaagagaaaagagagccactgggaagtttaaagggctaggattagaagtggcactcaatgcttcctcttgcattccactgaccggaagtcttacatggccatatctaagtataaggccggaaaatacagtcagattaagtgctcaggaggaaaggatatagatttggtaaaaacgttactggaaagcggtcctaatccagaccccaagagagggttcttgaatctcgggcaagaaagaatttggggcaagtccacagtacaaagtgaaagtaagtttattaagaaagtaaaagagtgaaagaatagctactccatcaacacaggagggcgttcctgaaagtaaaaggagagacgtggccaccctgggtacaacgcttgcttatatataggataacaacaacaaaaccacagggagatgtgctctattacaagggtttgtgataaagggttaattttcctaattactatatattgcaagaatcaatattattatctctaaagcaaaattaggaaggcttctgtcagaggcgtttgaaccggagcaactctatcttgaatagaggctgcataaaataaggcggagacctattgggctgcattcccagatggttaaggcattctaagtcacagaatgagataggaggttggcacaagatacaggtcataaacaccttgctgacaaaacagattgcagtaaagaagccagccaaaacccaccaaaactaagatagcaacgagagtgacctctgcgcatcctcactgctgcactccaccagcgccatgacagtttacaaatgccatggcaacatcaggaagttatcccatatggtctagaaaggggaggcatgaataatccaccccttgtttagcatatcattaagaaataaccataaaaatgggcaaccagcagccttcggggggctgctctatggagtagccattctcttattcctttactttcttaataaacttgctttcaaatttgctctagggacttgccctgaattccctcttgggccagatccaaaaaccctctcttggggtctgaattggggacccctttctggtaacacttctgttttcaagatatcaggatatcacggcattcctgactctgggtctgtttagtaaaggttctcaatctgctcccttaactgtaaacatccagagactaggaattcctaacttcctgggaatgcagcctggcaattcccagccttattttcctagccctcactcaagatggagtcgttctggttcgaatgcctctgacaaaaacttcactgttttttatatgtagctggaaaagtggtcccaaacaatctttaagatgaataggagatatccccaatgataaggagtaaagaacattgcaatcagaagggttagtgtgaataaagatagcctggggttcataaatggtgaaaaatcacatgcacagtaagataaggctgtaaagtgaggcagaagttaagtcacagaagggattttacactatgccaaggagtttataccttgtcctaagggcaactggaagccactgaagctttttgattaaaagggtagggtggtcagctttgcattttagaacaatgcctttgggctaggtgtggaaattgtggggggctatcatacacagagatggagaggatagatttgagaaatattagaaggtaaaaatggaggggctaggtggctgagtgtgttagaggtttttgaaccagagcaactctatcttgaataggggctaggtaaaatgaggctgagacctactgggctgctttcccagatggttaggcattctaagtcacagaatgagggaggaggtcagcacaagatacaggtcatggccgggcgtggtggctcacgcctgtaatcccagctctctgggaggccaaggtgggtagatcacctgaggtcagaagtttgagaccagtctggtcaacatggcaaaaccctaattctactaaaaatacaaaaattagctgggcctcgtggctcatgcctgtaatcccagctactctgggagactgagacatgagaattgcttgaacctgggaggcggaggttgcagtgagccaagatcgtgccactgcactccagcctgggtgacagagtgagactccatctcaaaaaaaaaaaaaaaaaaaaaaaaaaaaaaaaacaggtcataaagaccttgttgataaaacaggtctcagtaaagcagccagccaaaacctaccaaaaccaagatggtgatgagaccatcaaccaagatggtgatgagacctctggtcatcctcactgctacactcccaccagctccatgacagtttacaaatgccatctcaaggtcaggaagtcaccctattggtctaaaaggggagacatggataattcaccccttggttagcatatcatcaagaaataaccataaaaatgggcaaccagcagccctcgagggctgctctatggagtagccattctcttattcctttattttcctaataaacttgcttttgctttgctctatggactctccctgaattatttcttttacaagatctaagaaccttctcttggggtctggatcagcgcccctttcctgtaacaatgccaaggagtttgcaacccgtcctaagggcagttggaagccactgaagctttctgatcaaaacggtagtgtggtcagcttcgcattttagaaggatgacattgggcttggtgtagaaattgtaaggggctatcattacacacagagatgaagaggagataatagacttgagaaatacttagaaggtaaaaatggcagggctaggtggcttattggatgtcaatcagcctctttgtcctttctgtgaactcccttcccttgtcttctcattctgagtaccctagctaaccttctccacctgaatgcttagtccaagttgtgaccagatccatttggctctgggggattagacttggtgccatttattagggatattggatatattccaatctcgacccaaggatctggcagggcaaaaattattactgaaattctaaaatgtagataaatttatctagaatttatctgggaattcaaatttatctgcctaatcattgttcattttatggccagaaatttatagacagccccattttctgaacagaaattcagagatacataaaattttctggaggtgtgctttacattgataaagttggggagggggtgctagatgggaaggaagtgctgtggctggggcaatactttccctccctatagcgacaagtgtcactggtcttccaaagcagtactgtgtaaaatatcccataaaatggggaaaatggtaacataaactagtattggtgctaaactagtggtttagcactcacgctatggcattagaggttagatcctgctttcctaacttactggttgtgtgacctctgataatcatttgactccacgggagttcagttttctcagctacaaatgaaggtagcaatagctctagtcctgcaaagttgttatgagatgtaatgagataatatgcattcagttcttggaagactgtaggaacaaattaagtgtaatctttatggtgagagaatggctactttcccacagacaagacatttgattcagctgcgtatgttctttagccatatcaatggtaataaatatgggttgaaaggattgatttaatgatttgacaaatattttcaaatatattcaacatatattgtgtatataatatgtgcctaattttggagacacagtgttgaaaaagagcaagcttcctactcaaattgaaatttaattgtagtgtcaaagaaaaacaatgaataacaaacaaacatgcaatatgatgctaagtagtaatactgttatgaagaacaaataaaggagggtagaaggtatagaaagtgacaggagatgcttttaggtagaacagaggtctgaataatgcaatgaattaaagggtgaatgaggaaatgaatgaggagcagaaggaagataaagcagacagtgtgatggtagcttccaagaacacttcagtccagataaaaatgtgtaggatggatttagactttccaaacataaggttaactttaagagtctagaaagtgataagtaaattaaagcaaaaataaatagaagaaattgatacaaaaaataagagctgatataaagaaataaaaaagcaaacagataaaagcaaaagttggttctttgaaatgacccacaaaattgattaactgtcagattgctgaaacaaaaaagagaaaacacaaaataccaatatcaggagtgaaggagacattgtaactacagatcctacagacattaaaagtttaagaagaaaacattaggaataattgacaacatattcaataatctatatgaaatggtgacattctttgaaaaataaaactcaccaaaattgacacaagatgaaacagaagatctgaatgatcctaaatctaataaagagattgagttggttttcaaaaacatcctcacaaagaaaactcgaggcccagatatttcactagtgacttctattacgcatttaaggaaagaataataacaatcttatatgaactttatatgaaaattaaggatagaacactttctaactagttttatgaagacagcaaaacccttataccaacacttgccaaaggtatcacaaaaaaatcataattacagatcaatataatttatgaatacttctcaaaataaaaaaatgcttaacaaattgttcacaaactaaatccaataatatataaaaaataataatatgtcatgaacaagtagagcttatcccaggaatgtaaggttggtaattcaccatattaacagaaggaggataaaaatcatataatcattttaatagattcagaaagcatttatcaaaattcaacacacattcatgaataaaaactctccacaaattaggaatataacagaacttaatcaagttggtaaaagatatctgtgggaaacctatggctaaacatcacacttaatgctgaaagactgaacacttttccaataaagatcaggaaaaaggcaaggccattttaccacttttatgtgacattgtactagaggttatagtcatttcaataagtcaaggaagggacataaaagacataaagttgaatgctagacataaaactgcttctatttgcagatgtcatgagtgtttatgtagaaaatattaaggattctagaaagcaactactgcaaataataaagcattttagcaaggtcccaagatacacaattaatatcacaaaaatcagttatgattttatatactagcagtaaacaactggaaaatgaagttaaaattttcacttagcctcaaaaaacatataatacttagaaataaatttaacaaaacatacatgaaagttttaaattgacctattaatataaaacattcctgaaattaaaggacattaaataaatggagagctatataccatgatcatagattgagtgactcaaaacacgtggtaggatgtttcatttttcattcattcttcacccaactccaacacacacacacacacacacacacacacatacacacacgtgcacacacacattgcttcttctccagctttaaagttatccaactgaaaatttaatattattttattgtggtaatgtgagatgaattaaatgtcattttactaaagatgtctccccacctatggcctattaaagcacctgtaaccactgtatgaatcactccaaaaagtcactttcttagtggtagaacaagactctgcacgatgtagactctgcataccttcccatccacatttttcagatttactgaatgttttgctcattccatctctagtccattggcctttgcatttgccattcattccggaaaatttccttccctcctgttgcaaaaccattagatctcagcttagacaaatactctaggaataatgaaatgtctgccgttcctccaggaagggtcccaccccaatcacagactgaacaatgtttacacataaacacattcccatctcattcatgtaagtacagtttgcaagaaatctgcgatgcaaatgtgtacatattttcaaccaatgcttgtggggaaacattgtgctttgggccatttcaacttcaaaatctaatgaatctaatcattccaaatattctcatgggattaataacatatcttatatgtataaagcatggcctcttcccatgagtcccgactacaaccagtgttttggagaatgtgtttcactccaacattcagactcctgagatcttgataggtatgtaaattgcctgtccaatctccattctccccttttttcttggtaacagagccctgattttattcagagaagcaatacatctaactaaaggtctatatccccagccttcactgtagtaaggtaggacagtgttgactaaattctgacctttatagaagtgttgtgtggcttttcaaggaatattcttaaaggaagctgattggggtgagaactatgttttcggggattttccctctttttccttccttcctgctgtcaataaagtaaccgtgatgaccagaactttaacaactgtgtttgaccatgaagctatcttgaagatggagttgctgtgggctcagttatgccagaggagacaacaagaggggtagaaactacaatatctgctttgggcaacgtacctctgcactgcttttcatgggacagtaagcctttgagagtccgagccacggccattgagcgttttcggttatttgcagctgaaccttatcaaactaatattgacaacttgggaatttaaccaacaggaagtgaaaaacatagctgccccagcctccaatcatacaggaaaggaggagaaaaggggggagaagagagaggaagaaaaggagttgaggaagaggatgaagatgatgaggaggaagggaaggaggaagagcagaagaacgatgagaatgagaaagatggggaggaggacagtgaggatggggaggaggacagtgaggatgaggaggaggattatgaggaggaggactgtaacagcagcaaatacatagatggtgcatgtgtgccaggccctgttacctattcttactgacttaatcctcttaatcaaccctatgaagtcactattatcatccccattttataaataaggcgaggctaagagaggtgaaataaatcacctgtggccacacagtttatggttgaaactgctgagtttactcctgctatgatcaaacctctttcctgtgtctttgaaatactgaacagcaaaggctgcaaggattggaaaccctttttagagatttcaaggattgccttcttgctttttagtttttcttggtctcgcttcccccaactattttgtagattcctttaaaggaaggagagtaacatggtttgtgaaaaaagtgaaatataatgatatgatatataatgtaaaagtaggcttaaagatacttgaaaataagtagtcataacagggaaaacgggcacatccaaaaactacaatcaaaagtacaagggcactctttatataacattctcaaaacgtcaaagttacagcgacatgccaaaaattatacaaatcaatggtttccagggttagggttcggggaaggctgtgctcgtcaatagcattgcaccagtgttagtttcttgggtaaagaagggagcttcaccattacctctgggtcatcctgggcacctctgtgttgactgcccaggtcatattctgttaacacggcttaaaaaaatttttttaaaggaaaacaaaagtgactttaaactcacccctgaaaaaggttattaaaagacagtatttactttacaaaaaaaaaaaaaaaagcaacccaacctctttgcagaagttcataaaaatccctgtacgcatcaagactgagaggcttttcaattataaatgagactttaaaaggtagacagaacccctgaagcttccacataccacgcaccattgtggcggatggaaggaaaaccgtcgccctgtgttgacggcgtatttataattgaagagtttgagaacgcaaatgcaaatgaatcaacaccaacagggatgtctaaaagacataagtgagaattacggcaattaagaatgttgtctcagaggaaattagactgggccattaattacaatgccttaaagggaaagaggtcccagtgaaaatgcaataaattaaaatatcaaaaagaaaattagtgggaaggaaacatggaagtgccaatgagaagctaatctcagaggtggtgatggggaagagaagggagaaggcatattgaaagcgaatattgaagaggtgaggcagacctgcccaggctaaatcctcctgccctcccttcttttctcctcctctgtctccttccttccctccttcctttttctctccttttcttctttcctctctcctttctcacctcccatctctattctttccttacttttcttcctttctccttccttctcttacccctccatacttccccctttccttccttctctactccccctttttccttccttcccaccattcttttcttcttctgaccttccctgctctctcctttcacttttcctgtcccctcctttccctgtgacttcaaagtaccaaatcctaagaggcagagacacaccaggagccatcgctctgcccagggagaaattagaatctgccttgggaagcccacacgcatctgctgctgcctggctgcatctcccctgcccttgccctttaaatcagctgccaggctcctcaaggggagcagccactagactgtccccagtgaatggcccaggtgtccctgctcactcctggtccagtgacactctaatgttccttggctttaagttctcaaaaatcatgtgtatttatttgtctcctcaacttggcagggaaaatcttgagcgtgtgtgtgtgtgtgtgtgtgtggtgtgtatgtgtgtgtgtgttttgttttgacatggagtctttgttacccaggctggagtgcggtggcacatcttggtctcaaagcaacctctgctcccaggttccagtgattcttatgcctcaggctcccgagtagctgggactacagtcatgtgccaccaggcccggctaattttgtatttttagtagacacagggtttcaccatgttggtcaggctggtctcaaactcctgacctcaggtgatccacctgcctcagcctcccaaattgctgggattacaggcatgatcaaccacgcctggccagcttttgttttttgatataggtactaaccagaccctctggatgtggcacctcctctcttctggtgttcttccaactctacaccatggacatcctctaaccctaccttgccgcaatccagcatccctctctgccacaggcaggaatgaccaatcctccaatttcctcacctgtctaggcttccacatgacattctcaagtatctctatgataggaagagttgctttctatggtgcaaaactgtcccaacttcagtggtttttttttttttttcctgtaaacactttttacctgcataatgattcacttaatagtactctttaaaaaaccgcattaaaaattattttaaatttcaatagttttggggggacagatggtttttggttccattgataagttctttagtggtgatttctgagattttagtgcacctgtcaccagagcagggtaccctgtacccaatatgtggtcttttatccctcactcccccaacttaccttccccccttgagtccccaaagtccactatattattcttgtgcctttgagtccacacagcttagttcccacttataagtgagaacgtactatatttagttttccattcctgagttacttcacttagaataatgtcctccagctccatcctagttgctgcaaatgatattatttcattcttttttatggctcagtagtattctctgctgtgtatataccatattttctttatccacttgttggctgatgggcacttaggttggttccatatctttgcaattaaaaattccattttatttatttatcgagatggagtttcactcttgtcacccaggctggagagcaatggtgcgatctcagctcactgcaacctccgcctcccgggttcaagcgattctcctgcctcagcctcccaagtagctaggattacaggtgcccaccaccacacccagctgatttttatatttttagtagagatgaagcttcgccatgttggccaggctggtctcgaactcccgacctcaggtgatccacccgccttggcctcccaaagtgctgggattacaggtgtgagccactgcgcccagccaaaaagtccattattttaaattcaaatactttagcctcacctgaaagcaataacatctgtgaaaccaaggcttttctacacaagttatggatctttttcttgtgaatattaacataaacacatgtctacacaacgtaaaatgtccaatcagtttccttcatgggtttgcctcttgtgagcggcaacacttcttgtacaagaaacactgctggggtgagaaagtacaggatacgaattaagtacaatccaatttggtttcaccacctgctgtaggatgttgggaaaactgggtattacccttggatcctcagtgtttccatctgaacactgggtataattatgtttgtctttctaacggttgtttagggacttaatgcatgtagtaggatacatgtatttcctttctccatgactataactcctatctccctatcctgtgtgttcaattcactaggaggctgggacaactttaataccacttttaagtactggtcagatgtctagccccatacctcatgtttgcttaagtggtggtatgagaacggcgagggcgtctgaacttctttcaaagtagaccataagctctttgataaataggcaatatttcacaattctttgcatcaccttgatgctcacctggtgccaagcatatggaggtgctccatcaatacctgctgacccactgattgatttcccattctggccagaactctgagcacagtcaatgtggggctctgctggaggtgtggaggtgaggtcggctaacagcttccatggagcagacctggctttaagacatggctgcaaatagttccccaagctcgaaggcttgccaactcagctaccatttcccatctgtgtttctatttttcctgtgagagtagctttattgatctcattaattctcttttccatttttggcatgggaaggtgatattatccacgctttaatgccttctgtgttttgcaaattacaggattactatagatggaatgaccaaaaaaataaaaataaaaaaacactgttttcacagaattgtggcaaaagccatgaactgtccttcatttaaatagatgggggtaatctgtcctggggggtccattcactcaggtccaaggtccgcaaacacagagggagaattttctctcagctatttctgtgtgaagcaatgcaaatatttttctcacttgaacattttcgtttttgaattactgatggcagtgataggtttcctaataaggtttcttttcttcttttacagcaattacatttgactattttttcttctcttcattgaacattagtttgaggaggtcttaaaaggattcatctgaggaatgctgtggctcaaggtttggagttcaataagtattttatgaaaaagaaatctctgctgctctgctgtaaagacaaggaaaagtacctcttatgcaagttcttttagttcgataactaattaaaatcacaaccaccactaagagaaaagtttctcctgatcttatctactgctacttagaactctttacaagagaaggagaaagaaaaataaaataagtgatttccccatagactgtgggtctcccaggacaggtctgctttatctttatgggtctccccagagcctaggttagtgtctagaactgcgaaggcacctaataaatgctgactaaagagcaaaatgaatggacttgttttccttttaattttttaattgaaatataataatctatatgctcaaaagtgcagaaatcctaattaaacagttagatacatttttacaaatttgcaatcacctgcaaaaccaaaacctcaatcaagaaacacaataacataaccccagaaatcctgtacccgccactttccaatcattatcctccaaatataaccactgtcctgacttctaacagcacattctagttttgcttttgggattatacagggtgtcttcttttgtgaccatattcttccattcaacattagaattctgaactccatctgtactgatgcatatactttcagcttgttcattctcattgctatagggtgttccatcatgggtgccatggactgaatgtttgttttcccccaaaactcattgattgaatccctaattagcaatgtgatggtatttggaaatggtgcctttgagaggcaatttggatttgaagaagccataagagtgaggctcttatgatgggactaatgcccttatgaaatgaggaaatgacatgagatcaatctctttttctctctctccgcttgtatatgcaccaaataaaggccatgtggacatatgagaagacagctgtctgcaaaccaggaagagggccctcaccaggcaacaaattagctggcaccttgatcttggactttccagccttcagaactgtgagaaataaatatttgttattgaaaccacccagactgggtgcagaggttcacgcctgtaatcccaccactttgggaggctgaggcaggagtatagcttgaggtcaggagatcaagaccagcctggcaaacatggtgaaaacctgtctttgctaaagatacaaaaattagccaggcatggtggcatgtgcctgtaatcccagctattccgggggctgaggcaagagaatctcttgcacctgggaggttgaagctgcagtgagctgagactgcaccactgcattctagcccaggcaacagagagagaccttgaaacgaaaaaaaaaaaaaagagaaagaaaagaaaagatagatcatccagcctatgatattttggtatggcatgcaaaactgaccaagacaatggaaatatgccacaactaatttatccattccacagctgatgggcatttggcacctttaagtttggagctatcatgaaatgcattgccatagaaaatctaatacgtgtcttttggtaatcacatgtttttctgttgggttgtgtccctgggaatggaaatggatcataagatgtgtacagttttagccttggtggaagctgcccaacattttcccaaagggtttataccaatgtatattcccagtaacagtacataaacatcctacttgctccatatccttgccagcacttgatgttgtcagtctttttaattttagcattcgggtgggtgtgtagtaggatctcattgtgtatgtgtgtgtgtgtgtgtgtgtatgtgtgcaatttctctttattttgagataattgtagattcacatgcagttgtaaaaaataatacagagatatgtcatatgcccttcactcactttctcacaatggtaacatcttgcatacctacggtacaatatcgcaatgtggaaattgatgttgatagaatctaacctcagtcagatctcaccagttttgccatgtatagagtcactgatcatcacagtcaaggtatggaacagtgtcactgcaaggatctttcctgctacttttatatccactgctatctccatgctgctccctaacccctggtaaccactaaactattccccatatccataatgttgccatttcagtaatgttctatgaatggaattgcatagtatgtgaccttttgagattggctttttccactcagcgtaattctgtcaagatccatccaataggttggttgcctgtatcagaattgcattccatgaacaaacttttgaagaaactacgcatctcatttccaaacagttatttttagtagtttatttgttttctattcaagggatggcaaaacagacttgcacatttttttcatttgttcattagtttaatgaacatttataaagtaccaactgcatgttgagcactgtgctagatggtgagcacccaagagacacacagggctctgctacgtagggttttccgaaaaattagctgggcctggtgatgggcacctgtaatcccagctatttgggaggctgaggcagaagaatcacttgaacctggggggcagaggttgcagtgagccgagatcacaccactgcactccagcctgggtgacgagagcaaaactccgtctcaaaagacaaaataaataaataaattggggagacagacttatacatttaataagacaatacagcattacaggtggcaacacagagctgtgcatacatttcagtcaggaataaagaaggaaatggctgactttatgaggatagggtggaagacgagtccaggagatactttttaagggcatgatgcataaaccaagtcttggaagttgaataggttgcctgatgtctgtggatgagagaggaggcaagagaaaaaggggcgtttctgagcataaagaacagcttaggcataagcatggaggcgggaagaagtcgatactcaatttggaactcagcacaccaggattcactaagcctgaaaagtgagtggggctgctgaagagatgaagagttaaggatcaccatctttcaggaacactcattcttactgaagacacagtcccaagctgctgcccagatgccaccagcagaatcctactgaaacattgaaactgcccttctaaagtttatacaattaattagggaagaaaggagggagcttacagcacattcagcattaatcattagggagcttgctctctgatctgcttcctcacagctgtttggcgcctattgcctcagaatcacatagaccctgtgacaaggttatatttggttggtgcaaaagtaatctcagttttgccattataagtaatggtgaggccaggtgcagtggctcatgcctgtaatcccagcaccttgggaggctgaggcaggtggatcacttgaggtcaggagttcaagaccagcctggccagtatagcaaagccccgcctctactaaaaatacaaaaattagccaggcattgtggcatgcacctgtagtcccagttactcgggaggctgaggcaagagaatcacctgagcccgggaggtggaggttgcagtgagctaagattgtgccactgcactccagcctgggcaacaaagactccgtctaaaaaaaaaaaaaaaagtaatggcaaaaaccgtgattacttttgcaccaacctaatagctccccttaactgctctacaaataacaaatcattcattgtgaaatgttatgtttttcatttgagatattctttcaggtcctacacaccagtgaaactactgacatcagctgctctgaaggacttcacaagaagctaactcaccaaagaatgcagtttccatatcttgatggtttcatcccttttacccccactaatcaacaactccaattttccagccccttgcctgatggtctccttaaaagccccagcccagaactcctcagggaagtgaattggagggtccctgtctccttgcctggttgccctgtgaacattaaacactttctctgctgcaaaccctgctgtctcagatttttagtctgttactgcacagaaggcttatacacctgtcagtcctgtgacagtaatatgagtcttctgggctccagccacactgtttacaaaacagtttacaaaactgtttctcacagacccctgcattagacacgaccaaagacagtgacttgagttacacggcttttacatttctgtctcatgagtgtttatctgtcagttgtgcctaacacagagcacacacacacacacatacacacacacccatccatccacctaccttggtgtcaaacacgcaaactttctttcttgccccttcccctgaaatgggaatgagaggcattccttaagtactcacaatagtaagcacatatgttacccctcctctaagacaatgttccaagagccttccatatgtctgttccttattatagtcctctgatctaagtaggcctattatcacacccaatttctagataaggaaactgagtcacaatgaggctaagtgactcaccccaggtcacacagctcagttcgcagagacgagcgcactcgcgtgcctactccctccatgagtgtggcaacaaggagggtatggactctggagactgattatgtgaataaaacctggccctgctgcttgtaagctgtgtgacttgggtgggtcacttaactcactgtgcctcagtttccttgtggatacagtcaaggtagaggcagcctacctggcagtaggtgctgaaatgacagtagataaaaagatcatgctccttcagcatgaaagggtttcaagtggaaagctcaattcttcttctaaaaagttaataggatgaagttagagggttcatcagtctactcagcatctaaaccaacacactcgcaccaaggctaatgtcatcatgacagttttcagcccacaggtgtctcctgatttaattatcaagagagtcccattacttggtatatgaaagtgagataaaaacctatccaaggggcattttcttcggcttccatttttggatattggcacttgctgattcccctctctgccttgtgctaccttcttcccttcctccttttcctcacccagttaatgcctcacttccttagaactccagccaaagagtcaatgccccaggtatatctaccttaatcttctaaggctagttcagagctccctgttacatgtttgcatagcatcttttatttttccctgagttcttatcacaatttataattatatataaatatgtgtgtgtgattatctacttaataaacatctcttctattataatttaagagtaatagaactgagacaatctttatttttacttagcatttaatatccatggcatagtacttgcacatagtaggcactcaatacatgcttacagagtagatgaatgagtaagcatatgaaaaaattaaaaaatctgaatgaatgaatcaccaaagtttcatcaaaaagaatttgatgtcctgtaatgacttcgattccctgaaatgtcttggttgctgctggtgccatagactttctggacacccaaggaataatatttcagatagactcatgaggtttccaggcttctgcgaatcaaatccagcccagcccagcccagccttcctgggaagtctgtatttaagtcccccagtttgatttccatcatcatccactgcaagcgagagcagttgattttctttaattaaggcaggaaggatggcttcctgaatgggtaatatatctcccaagttcagcatttcatctgcacagcccacatttcactcggaaatgggacagattcattaaaagtatggccagacagcttcctctttggttgcttgtttgcctacctttaatgaatgaatacataacgtgcctattcattaccaacttttgagtggaagtaattgctgggttccctcgtttgcttggaacaatgttctttgcatttgaagtgtcttctgcctcagtcaccacagtaattcccaatcaatgggccaaagacaccctccaggggcagatattcacctccagctcacctttgagagaagtaatcactcttctagtcctccagggcctcattcagtgcactaggaatgctcatttatggcaggagaccctgggaccctaagaagtaaatgagactgggaggcccattaattctctgagtacaccctgggggcacctggggcattataatgtaattactactaagaaagactaaattccaatgtactttgtcaaaaagcattttacagaaagtactcagtttggccctccctatgatcatgtgcttaactttggccacaggaaatctagggggccatttgggtgactcttggttgactcaaggtttaagggacccttgagactttatccctcatccccaaatcattaacaaacatttgccaagtgcctacactgagtataaattaaagattactgggtccctcatctgtatcctggacctgtacaacacagctgttctagtggtctcccagcctccttcactgcctccgccagttttattttctccatgattgcacagtggtctttccaaaacataaatgtcagtggctcacgcctgtaatccaagcacgttgggaggctgagccaggtggatcatttgaggccaggagtttgagaccagcctagccaacatggtgaaatcttgtctctactaaaaatataaaaatcagccaggcatgatggcatgtgcctgtagtcccagctactcgggaggttgaggcaggagaatcacttgaaccagggaggtagaggttgcagtcagcagagattgcgtggctgcactccagcctgggcaacagagtgagactccgtctcaaaaaaaagagaaaagaaacacaaatgccatcacaacagtcccctgctaagaatcccaaggcttccccttgcccccaggattcaggacaaagtcctcttcctgattcacaggaccttctttgtgcaatctggccagttttgtatccacctaccttctgtcccactttgtaagcatctgcctgccgtatgaagctacttgcagttctctgaatatattccacagttcccacctcgatgcctctgcccacacattttcctccacctcctccctatgaccatcttgtattatttgaaacgctagatcagattcagagccctagaagagagaggcaggttgcatcactttacgatcagagccatgagtaaagtgatagggagtggtgaggaatgggacaaactggtgagcacacgccctctctgtgaggggcagctataccacccagcaatatctaattgttgccatgaaaggatgtgggttcagtgttttcatatccactactttccaggagaagctgaaaatctgaaattttatctgaaatattttttaaatatggtatactccatcgtaacttttaaaatgttaaaggccttccaaagtgggcctgagctcttaggtgctagctgctgactcttgacctctacccaacaggggacacctccttggtgaagtcatctctcctttgtgtcaacattataacttgtggctcaaggaagagcttcagcgaccaatctttgtgtctctgaaagttggcatagtacatggcacacagtgaatgttcagaaaatgtaggataggtaagccaatgaataaataaagtcagtttcttcccccaattggaagcttataaatcacatacacttcaaaaaggctgggggatgttggtgtatcctttttaataatcaggcaaaaaatggttttttatagccagccttcaaccccggtcataagagaagttggcatccacttgtgaaaagcaatttgagagagaacactcagtcctgctgtctaaaaatatctatcacctataacacctgcaatccccaacgttatcacctttaatgggttacattgtagaatattacctttgcaggcatcgttgggaactagcccttccctggcaggaaatggaagaagtgttgtcagctcctaaaagttaatataaatatataccgggttcttttccaatatattctacaaaattgctgtatgactttaggcaacttcctttatcagaaccctactttccccatttataaagaactattctgggccaggggaggtagctcatgcctgtgatcccagcactttggcaggccaaggcaggcggatcacctgaggtcaggagtttgagaccagcctggccaacatggcaaaaccccgcctctactaaaaaacacaaaaattagccgggtgtggtggtacacgcctgtagtctcagctacctgaggaggctgagggaggagaatcacttgaacctgggaggcagaggttgtaagccgagatcgcgccattgcactccagcctgggtgacagagcaactccgtatcaaaaaaaaaaccaaaaaactatatatatatatgtatgtatgtataatttttttgagattctctctctctctctccatatatatatatatatatatatatatatatataattttttggagactctttctctctctctctctctctatatatatatatatatatatttttttttttttttttctgggccagtgtctggggtcttcatcattattattatatggtgtgcaatgaaattagaaaactgctatcttagaccaggttagaaactcaaatatatgtaggaatgaagaaagagaacaataagagctgggaggggaatttggcaaactggaaagctcacatccttctggagggaagagccgctgttcaattccagctcactgttgccacaagggagggtcagctcagagctacctgatcatctgatttttaaacagaagccagaaatccatgattttatgtaaaatatcccaattgcttactaaatcacctgagcaaacaaacaaaaacagtgttgccaaaacaaaacatctacatggactagatttaatctacccatgaaccaatttctgggaggtggggaatggaagtgggctcaacctgtatcacatgtccacctcccttctcatggttccttaagtcacaatcgaaagaaagcagacaaaagctacaggtgggcggggtgcagtggctcacacctgtaatcccagcactttgggaggccaaggtgggtggatcatctgagatcaggacttcgagactagcctggccaacatggtgaaacctccctctactaaaaatacaaaaaattagtcgggcatcatggcaggtgcctgtaatcccagctacttgggaggctgggggaggagaaccgggaggcttgaaccaggaggcagttgcagtgagccgaggtcgcgccattgcactcccacctgggcaacaagagcaagattccgtctcagaaaaaagaaaaaaaaccacaaaaacaaaacaaagaaaaacttcaggtgtctgctacaaggcacaaatcaaaaagactaataccacttgagcttcctactgttttttttttccttgagtcatgcattatttagcttgaaattggttgatttgaaaaagagcccctatacctattataagcagatcttcccttacccatataagatttctgtagcctatttccaagaaggaggcagccattaatgaaccgtgtgttcccacctctgggtcttgccagccatagagcaattctgctcaaggagaccctggttcacttctcggtaattctgacttctcagggaccggcttttgtttattttccttcctcccaagcatacatatttcatctggcagcttttccacatcagcaaaatctgtcgtgccagcaccagattcctcttgtgcacaggctccatcctgattaactctatttatataatttattttggttgcccgtttcccgtttgggagatcgatacaaatttaaatgagaagcaagagtatttacagccacttcaagcgttgatcaaacacaggccaggatgtggatgttctgccttggagatgagtccctctgtgggatcatcttggtatcatctcacaaatggagagaaatggagaaggagaaaaggaagcagacagaggacggaaaaagggagggaggaagaaaagaaggaaaggatggagggaggaagaaaggaaggagaaaagagaaggcaagaaaaaaaaaaggaaaagaaaagaagtggctagactagttttccagctttccagctcagttggcaaataccaagcacttttagccttcggctcaacttttatacacatatctgcatgctgagacgtgtctagaagtaagtcaccaaagtttttgcttatattagttcccaagtaaagcagaagacgctgccagcttatttgtgcatgagtttttagctgtcaatgcatatttcaaacagcaggcaggaactgactgcataaatcaagctctgcggggatctgctgcccttcaccaggctggtgtgtgatccaggatgtgatttgatttttgggctttctccttagcagaggccagctcaacggcccagccttcatgatctggaccaaattgtgtgtatttcggggggtggagtagcgcatccttttgttgagctggcactgcctccttttctttagttctcagtttggacactgcctgctatttcttttttttttttttaagaggaggaggtggctgtaaaaagtgtttctccaagagacccatgtggtcaaggagcggaatgaggagtgagtcaggaggcctttgtcatggtttgactctgactttcttagaatgaactcagtcctattattctctacccagagccaactgtagcatctccacccatggggaaggctatggtttatttaatcaacagaactggtccatttggctctccattggtccattctgatgtacagaaaacatggatctgtacatcaatcagatacaaaaatcaattctgaatagattaaatatgtaaatgtatacaagaaataggaaagaaagtaagaggctctatatataaagagttgtttttatatggtctttggttgaacagatcttaaaggaccaggatgggggaagaccttcctaatctagacagaaagtccagaagctatgaaataaatggttcacaaactgattacaaacaggttgggtgtggtggctaacacctgtaattttgggaggctaagacaggccgataacttgagtccaggagtttgagatcagcctggccaaaatggtgaaaccccttctctactaaaaatacaaaaattagccaggtgtggtggtgcacacctatagtcccagctacttgggaggctgaggtgagaggatcacctgagcctgggaggtcaaggctgcagtgagccaagatcgtgccactacactccagcctggctgatagagtgacaccctgtctcaaaaaaaaaaaaaaagaaaaaagaagttaggaaggaagttaggaagaaagagaaagaaaagaaagaaaaggaaagaaagaaaagaggaaggaaagaaggaaggaagaaaaagaaagaaggaaagaaggaaggaaggaaagaaagaaagaaggaaagaaagaaagaaagaaagaaagaaaggaagaaaagaaaagagaaaagaaaaagaaaactgattacaaacaatgtattttaagatctgttagactggctgggcatggtggctcacacctgtaatcccagcactttgggaggctgagacgggtggacaacctgaggtcaggagttcgagaccagcctgacccacatgcagaaaccctgtctccattaaaaatacaaaattaactgtgtgtggtggcgggtgcctgtaatcccagctactcgggaggctaaggcaggaaaatcgcttgaaccagggaggcagaggttgtggtgagccaagatcacaccattgcactccagcctctgcaacaagagagaaactaggtctcaaaaataaataaataaataaaagagatctgttcgaccaaagaccaaataaaaacaaaagacaatgacagactgggatggaacatctgcagtacatatggtgctcaaactgttaatattcctaataactaaagggttcctaaaaactgaaggaagaagataacccagcttaaaattggagaaaatatatgacccggtaatacattaacgggaagccatgaaaacacttaccccaatccactgatgagtggaaaaatggaaactaaggcacctatatggcaccatttttctcccattagtgtggtaaaatgtttaaaaaattaataatctcctgtgctggtgaggatgttgcaagggaaatggccgtggtgcagtcaagagtaggctgaggtaaacatgcggcacagcatgacgcagtggaattggagtgcaggctcacaatcccgtgcattacataatcacagttatggagccatgttatgggagggctcatcacctgtctctgagccacttttgttcgtgaggtgcataaatacatcactaacactgtgagaggggggtcgcataataaagccatctgtcacctgcctaaagctccctccaactcaagtggtctttcaactacccaccacctgtccaccaactccccttgatctcagcttgggttggaacctgacagatgtggagaaatggccatgacagcaacaaatggctgaaactgcaaatttattttgcaacataattaatgcaatatgtattaaaattcaaaagattcttatcattaagccagcaattcccttttttgaagcaggtacaggagaaataaaagctatacagaggtttatttgtacaaggacatgtatgcatattgtagcattgtttatggtgtccccttccaaggagagaaaaggaaaggaaaagcaagacggagcggaggcagactcagagagagagagagagagagagagagagagagagagacggggacagagagagacggagacagagacagagaagaaaactggagacattctcaacaaatatttagaataaattaaaagcaataagcattaataaaataggataaatatttgagataactgatgtggtcatttagaggaataagtcagatctatgtgtactgtcatggaagaacagcaatgatttgatagtaagtaaaatgcaaaaaataacccacaatcgcaaagcaataacaaaaagtacagggtaacagacttagcttaggttagttcatggtactgagaatgaagtttctaaggccagcctacttggattcaattctctccttcggttgttagctctgcaagctaattaacctctctgtgtctcggtctcctcatctgtcaactgagaaaattactggggcaattagatgagttcatcatgtaaagtacttagagctgtgcctggtaagcttcatcatcatactcttactattgaaagggtgctaatacagctgatagcctgcagttaggcaaccttggggctctagtcattgccagaacactgaagtattttcacaccagctggtaaagactgtcccccactattctgattattctaggcccttccctaggttcaaccccttactccaggcatccccatggtctagcaaataaaggtttaataccttggcttcccagtggtctccagattccaactccagcctaaggcttagaccccctgccaatctggctttgaattctgcatatcacctctaacaacagggatgtattacctgtgtacatttttgaaaacaatcaataaactataacagggaatataatgcaagcctacatttctgcatcttggtggcattcaccaaagccaagcctggcttctgtgatttgcaaatggctgccttctcctcctccacccttccctcacagagggaagtaattcaaattactctctacctgaagctagcatggtaaataattgaacctctaaaagaatataaaggcttaaaaaaaaaaactcttaaatattacctacacaggttttactgcaacctacagggtgtcttcctcaaattcactgctcaaaatctcttgagccccagaagtcttttagaataataccaggaaatgaatacccacctggtaatgcattataatttctaggtctggctgtgatggaagccaagtccaggtttgtacaagttggaaaagaataaaatgtccctggttacaaataaatagctgtgccaataacagactttaatgtactatatccccagaagcctgagaggagagaaatgagcaggacgatgagataatcggtctaaaagggcaaatcaagcccctctaagctggctttttttataggtgggcttgtaaaataggggtggagaaacttctgcttcaaaagcaagaacaatgaaaatgaaagttgctatttcaagactgaaaatatgtgctcaggctacagaggatactctcccagggcccatttcacaggtgaggaagctgaggtgcaggacagttaactctcttgcccacaggtctgaaaagcaataacatttgttgagcagggtgtgaaagcaggtgcctctgtcactacagttcacagaagtctgtaaaatgagacatatctgtctcgagacatagggacacagaaagatggtgagagagacaggtttatgacatgttttgtgatcggattcatttgccagagcctctgaattaaagattagaccagtttcatggctagctcatgtcaggtctggattcatttagggctggctggttggtttgttgattttgcagggctgagtcccttcccatcaacatacacacgtactcctgccttgttcaggccacctttacctgctctttgatgctgcctatgcagcgagtgagttagaggtgaaattgctgctaactactaagagtccctgcccccttgcaactgacaacagatgacactgaaatgaaagggaggaagggaagacctcatgagttcctggtgcttgtggaaggaggagatgcattataattatatttatacaaggcagcgatacttcacctcctgaaatcgttaggcaatgttttgtttatatgctcctatgttctgggggaggattttctggggagagcctccctcaaattctcaaagggatctgtggcaccaaagaggttaaaagtcgattgtcatgggtgtattagtctgttttcacgctgctgataaaaacatgctgggtaatttataaagaaaaagaggtttaatggactcacagttccacgtggctggggaggtctcacaatcacagtggaaggcgaaaggcacgttttacatggcagcagcaagagagaacaatgagagccaagcaaaaggggaaaccccttataaaaccatcacatctcctgagacttactcactaccacgagaacagtatgggggaaactacccccatgattcaatcatctccccctgggtcccttccacaacacgtgggaattatgggagctaaattcaagatgaggtttgggtggggacacagagccaaaccacatcacatagggtctgtaaatcaaatatgtccggatagtcatccccattcagtccttctttcattcaacacataatgagctcctactatgtgcacatcagggtcaggtacagggattacactggtgaatccttccttcatggaccttatattttagttggggacacagacattaaagaattcatccggtgactcatggatatgatggtgttaggagcttcaaaaagcaaggaggaagtgaaatgaggacctatttcctagtacactctgggttagggaagacttccttgatatagtgatatttaagctgagctcagaagcatgagcagttagtggggaggggagggttgccggaggagtgttctaaaccctgggtgcccagggggatctgcagaccagcagcatcagcaatgtctgggaactcattagacgtgcagatgctcaagccctgcctcagatgtaatatgtatttttttttttttaggtggagtctcactgctgtgtcacccaggctgtagtgcagtggtgcaatcccggctcactgcagcctccgcctcctgggttcaagcaattctcctgcctcagactcccgagtagctggggtgacagatgtgtgccaccacgcccagctaatttttgtatttttagtagagacggggtttcaccatgttggccagactggtctcaaactcctaacctcaggtgatccgcccacctcagcctcccaaagtgctaggattacaggcgtgagccaccacacctggcctaaaatcttaaaaattttaaaaaatactttcgacttttattttagattcagggagaacatgtgcaggtttgttacataggaatatattggatgatactgagatttctggtataaattatttcatcacctaggtagtgaccatagtacccaatggttagtttttcaacccttgccctccttctctcccctctctagtagctcccagtgtctactgttgccatctttatgtccatgtgtacccaatttttagctcccacttataagtgagaacatgtagtgtttggttttctgtccctgcattaattggcttaggataatggcctccagctatatccatgttgctacaaaagatatttcattcttctttatgactatgtagtattccatggtgtatatgtacatatatggtgtatatgtacatatatggtgtatatgtacatatatggtgtatatgtacatatatggtgtatatgtaccatatgcatggtgtatatatactatatactatgtagtattccatggtgtatatgtaccatattttctttatccagtcccctgttgaagggcacctacatagattctacatctttgctattatgtatagtgctgctatgaacatggaaatgcatgtgtcttttctgcagaacgatttatattcctttgagtatataactagtagtgggattgctgggtcaaatggtagttctattttaagttctttgagcaatcttcaaactgctttccatggtggctgaattgatttacgttcccaccaacagtgtacaagctttcccttttctctgcagcctcgccaccatttgcagttttttcactttttaataatagcctttctgactagtgtgagatggcatctcattgtggttttgatttgccttttcctaatgaaaagtcctaatttttaacaagatccctaggtgattgatatttgcactgggggctgagaattgttcctctgaagagaggcaggagtatttgaggaactgtaggaaaactggtactcctgaaactcagaaagaggaggaggtgggggagatgaggctggagaggcaagagcagagacatcagattcttgtagccatgttaagaataaaagaaatatttgagggcaagtgaatgattatgcttttggcaagaactttttttaaattaaattaaattttttaagttccagggtgcatgcatatacaggatgtgcaggtttgttacctaggtaaacatgtgccatggtggtttgttgcacctatcaacccatcagctaggtattaggcccagcatgcattagctctttttcctaaagctctccctttcccacctccaccctcccccaacaggccccagtgtacgttgctcctctccctgtgtccatgtgttctcattgttcagctcctacttataagtgagaacatgcagtgtttggttttctgttcctccattagtttgctgaggataatggcttccagcttcatccatgttcctgcaagggacatgatatcattcctttttatggttgcatcatagtattccatggtgtatatgtaccacattttctttatccagtctatcactgatgggcattttggttgattccatgtctttcagcaagaacttttaaaactctaatttggtagcttgggctatggggtttatatgtagaatgactgagggaaccagcttttgtttgtggtcgcctatccctccttctgcacattccacgcttcatctctgttttctcatctgtaaaatggggataacaagtcctctcttgcgcagtccttgggctggttgaatagattgttccctataatgcacatatgtcaggtccagtgcataagaagtattaacaaatgagtttacttctcattgtttcaagaaatatttgttccaattatttattctaagccctgaaataggagctggagatgttacactgaacaagatgtgacagcctcagggagcccaaaatcactctggggaaactaggactcaaatagatgatatgatagatacaataacaggcaaagtacaggtgccagtaagaatgtaccaaagatgggtaacagaatccagggagcctgtccaatgcttcacagaggaaaggatatcgaggctgatgccaaagaatgagttgaaattagccagacaaagaaaaggaaggtctgcacatggcagaccctacttgacatctacaacatccagaagcaacgagggatagctatctagaatatacaaagaactcctctaaattaggaagaaaacagagtaaacccaatggaaagatacaaaaaaaatcatcatcagatgattcagatatggagaaacctaaatggctctatgacctatgaggagatgctcaacctctttaataaccagagaaaagcaaattataacaaggcaccacttcctacccatcagaatgacaaaacagtagaaagatggcaaatgccaagaagcatgaagctgtaagctctcctttcttactggtgcgaatgtaaactggcaacaccatttggaaaagttatctggtgagtcttggtcaacataagtatgtgtgtgccttactgcctattaatctctctcctaggtatataccctaggggaatgctcacatactcataaaaggatgaatttaaggcatcaactttctttgtagcatcaagaagttgcaggcaactcaggtgtccatcattaggggattggctgagtaaagtgtgacagatgcacattatagaaaatcaaacagcacaaggaagtcacaagcaattttatagaaagcaaattatacagaaagcaatttggatagatcgtcaaacaatgcggaatgaagaaagcctcagaatggggtttccaacacagtgctatttatgttaattaaaaacactcaccatcaaagtaactctgcatattttataatatttacaaacacatgtctaacacatgagaaagggttcccctaggggaagagaaatgaaatggggactaggtatatagaggaagaaataaatgaatagtaaaacaagacaataattgaccatatatgatgatgcaccataggctaggaaatttgactagctcaacttatgcttctgagatccaataaataaacaaagtatcaattaaaatggaagtgtttcaggcaaagggaataatgtgcaatttgcagaagtaatggaggacatgatacattctggaatggagagagatcagtagaattgggacaaataacataaggcaggaagtgttaaggaaagaccagacatgaagaaccctaaagctatactaaataatcaggattcagcccaagggcagtagggagccattgtagtgacatgattgtgtttttaatcttgctccaagctccaacaatgagaaaataagccattccgctgagtcagaagcgcatgacatttctcagtattcatgtggcatatttatcaagtattaatgaaataagccttgagcatcttagcacccaactcatgaacctcatttttccccccttttataccaattatgagatagtcatcgacactttcaccaataaccaggcaacatacagaaccacatttactatttgaccttgggcaaagtcatctgaactccaaatatgagttgccttaatttctttatcagtaacaagaccacaagcatttcctatatccagtagccactggaatcaaacagaaagtgattttacatcttcaaaataaccttatgagatagatagtattcacattttataggaagaagaaaccaatatggagacagagatgttaagtaatttgcctaaggtcattaaccattaatagatgcagaagcacgcatttctgtttacagactgtttaagagtctattctgcgaaccacacctcatggtaccacccttagatggtagtgcttccttcaaagtttgtagcattggaagaccttctgcaaacagtgtgtttggcaacactggagcctagaaatcaatctcaaatgaatggcctctgagctactttgggactgtatacgtgttttctttaacccaagtaattttcttttttaaattctgtataatagcctatattttgaaatctgaagattttacgtagaaatccaaaattttggtttctggtgaaaagttgggaaatttgccaagactgggctcccattccctttcagaaaaatccactggagctgagtagcagctacacatttagagagggcatatgctctccaattttccacagtccccacccctccctaatacactaagctcatttctctcattcccattaactgcctaggcctaatggaattcaatgttatgacctctgttgtagggaataaatagtctaatcaccgagaggatgggacgagccaaggttttaaaaatccaaagcttgatctatctcagaatgaaaatgaaaattaaaatctttctggagatttatcttcctggtctcaattctcattggtcttttccccctttgacctttaatttcatttattatgaaacagccaagtggcacaacagaaaataccatcaaaatgtgagcactggggttgttccttcagaagctgaatgttaggcctggcttttccaataactctctattcattcaaatctaattacaaaatgatttttaatcattgtggaataaattcactcttcacatctagaaatgttaaagccctaatttaacagcaataaccaaaaaaaaaaaaaaaacaccctctaatggatttgcactaagaagcagaacatggcctgtgttgtcagatgttcaataatttaactgcaaatgaagtgtgtaaaatacaatatttgtgtcataaaccacccagcttgtcacataatagatttttgaagagtcatgtttcacggcactgagcaatgttatgttggaatggtggagtagccaaattgaggtttaaaggttccatttgcttatgcagaaagtgattgagtctcacttcacccagtgacaggaagcatggaaatacagtgtctctggatcttaccatttcaaagcagtggctggaattcatccttccagctagataacgtaactcatgttcaaccttccctatgttacaagatgtattttggattaccttacaagtctagtgggatattgtggttcctttgctatcacaggccatggtaggcagaacaatgtcctccccaccatcccatcttaaagatgtccatgtttgaatccctaggacctgaaaatacattgggtggcctggaaaagggggaattaaagttgcagataaaattaaattgctaatcggctgacctgaaaacagagattattcagatgggtctgatgtaatcacaaggatccttaaaagtagaaggaggagacagaagaggcaagtcagatggagatgagattatggcaggtcagggtgatgcaatgtgcaaagaactttactttccatttctggaaggagcactgactttccattgctggaaggaggatgggtccacaagccaaagaatgctggtgccctctagaagctggagaaggccaggaaacattattccctagagcctccagaagtgcagcagccctgtcaacaccttgcctttagcctagtaagatttttactggacttctaagcttcatgactgtcaggctaatacatttgtgttgcttgagccacttaggtggaggtaattagctgcagcagcaatagaaaactaatacattgataccaaagccatatctgtgggaaaataacagaggaattagaacactgccttcttttgctcaaaattagtagactaagatacaaacaaatgatgttactatatttcttcaattttactatgcatattcgtttttcaaattatacatttctcacattaggatttatctcacaattgaagaatacattgaatagagtgctcttccccaagtcctttcagcaaaattgaaagctgtcactaaatagactgtacgttgtacaatcttgagtaccccaaaatgacacaaaaagtgttcatcttaaggagtgagcaggtgaaattcaattcaacaagcattgattatcttgttagtaccaagcacgctgctaaacactgaggtaggccagacattgttgtttttgtgactttcacaggcaaatggaacaatgacctatacatgataaattaaaacaaaaactcagactgatgctatgattaattctccaaatgcaaaatgctgtgaggtcagggcctgtgcctgcctagttcatttccaagtcccctgtatctagcatagacatggcctagcacagggtaggtattcctttgaatgattgtctaagtgctttacatgctttatcttatttcctaccaggtggattatatggtgtcttcattttacaactgagggaactaagtttagaaagagtaattcatttccccaaagtcacacagctactagcagcttagaccagggcttctcagcatcggcatcattgatatttgagctggatcattctttgctgggggcaaggggccaccctgtgcattgtaggatgtttggcagcatcccctggcctttagtcaccggatgccagtaacacactctactccacttggaacagtcaaaaatgtcttcagatgttgctgaatgtccctgaggggaaaagggcaaaattgcccccagttgaaaaccactggcttaagcaaatgggcattaatattctaagtatgtgtgcttttaaaataacctccacaaaatctctgatactctccttttagagagttggagcccaattcctaccctattgagtattgagagaacttagtgacttgcttctaactaatggaatgtggcagacacaaaaggtacacacacgattaggccatagaaggcattttggccttctctttgtcctctctcttgaattgctggttctaggggaagttaactcccacatcatgagaatatataaacagacctaaaactctacatggtgaggaactgaggcctcttgcctacagccagtgaggagccaagctacacaatctgttgctatggagtaaactgtcatgggagaagtgcctccagtcttggttcccagttgaaccttcagataagtgacatccccagctggctgatgtcttaactgcaatctcatgtgaaacccagagccagagccacccagctaaaccactcttggattcctgatgctcggaaactgagtgagataataaatatttgtgttttaagctgctgagctttggggcatgtgtaatgcagcaatagatcacaaagacgaaaatgaatgacctattgagggaaaaagtaaatggtccagaatgactggtgtgtggggtgcatggcagaggagggcgcatgggctcgaggatacaaacagaggcagagctgaaggatctgagtgctttgtatatatcagggaaaaatggggaatcagaactttgaggctgggcatggtggctcacacctgtaatcccagcactttgtgaggccgaggcaggcggatcacctgaggtcaggagttcgagaccaggatggccaacatggcaaaacccccgtatctactaaaaatgcaaaaattagctgggtgtcgtggtgtgcacctgtaatcccaagctacttgggaggctgaggccagagaatagattgaacctgggaggcgtaggttgcagcaagccgagattgcaccaccacactctagcctgggcgacagagcgagactccgtctcaaaaaaaaaaaaaaaaaaaaccctttgaggattatgtagcacagaagttggcaagctatagtccagtggctcaatccagctatttttgtaacacccttgagtgatgaatggttttacatttttaaacattttccatatattttccccaaaacaagggaaacaggaaaggccaagaagggccagtttgcaaagggacttgaatgcaggctcaggagtctgaagttctttctagagacccctggggccataaaagagcaacaggacttgtgcatttttcatttcttaaaaacacaaatctgagcacatcattcttgtgtttgtttcccaatggcttcccgttgttttaagcataaagaatgaacactaagaaaatgagagatgacctttcattttcttcctgctgcctagctggtcagcctaattttctgccattgctccagtattgtgcccaacacacacacacacacacacacacacacacacacacacacactcacacacgtagatgcattccctccgaacagtccttctatcccagacatttttagttctcttacatactgggttctactgggactttgtctttgtcccaaatacctctccccatccctgccttttgggctacctatactaattgcccctttttttgaaagtcttcctgcttgggcatggtggctcacgcctgtaattccagcactctgggatgctgaggtgggcagatcacctgaggtcaagagttcgagaccagcctggcaaacatggtgaaaccctgtctgtattaaaatacaaaaatcagctaggtgtggtggcatgcacccataatcccagcaacttgggaggctgaggcaggagaattgctggaacccgggaggcagaagttgcagtgagctgagattgtgccactgcactgcagcctgagtgacagagtgagaatctgtctcaaaaaaaaaaaaaaaaaatcttcctatccttctcagtctagggaggtatggctcccatacattcccattttagtctgagtagatgtttatctccacactcatgagactgttttgtatttgtccatttatgcaattttcctccctatctagatgagagctccatttattagctgcatattttatctctgaaaatggtaaatgtctaataaacgtttgttgaacaaagaataaagaaatgataactgagttgccgctgagagctgtgtctaaagaaatccagacttctgtgtagtttggtagctgggtgatttgtcttggaaggtttctgaagaaaaataagtccagcattaagacgccttatcttacctgaggtaggtacataccttgtagtgcagctggacataaacacggatatagcagtaacgggtttcattctcttccacaaatcaccggaccagttcccctcagaacagaccaagaggcattaccgttactctgaaacatgacctcatttcactgactcatgggcagaaaccctgagttgctggtccctttccaccagtgtccctaatcttccctcatatgacaggaaaaacaatagctatccataaccctgatcattttcaagcaagtttgcctctgttaaccattgagaacccctgaagagcttgttgtggcatctgtctgtttttgtgaactgggttgggctcaaggatactaacaggcgcagctgaaggatctgagtgctttgcatatatcagggcaaaatggggagtcagaactttgaggattatgtaggactgatgtaggcaagctatatccactggctcaatccagctctttttgtaacacccctgaactatgaaaaatttttgcattttaaaaaaattattacattttagatggtcatatgagtatatatatcatttccttttttttttttttttttttgagataaggtcgtgctctgtcacccgggctggagcgcagtggcatgatctcagctcactgcaacctctacctcccgggttcaagcgattcccctgcctctgcctcccgagtagctgggactacaggcatgcactaccatgcctggctaattttctgtatttttagtagagatagggtttcaccatgttggccaggcttgtcttgaactcctgacctcaggtgatcgaccagccttggcctcccaaagtgctgggattacaggcatgagccactgcgccaggcctgggtacctatctaatttcttaaattttggctcttggcttgcaaaggctaaagtatttatcatgtatggccatttaagaaaagttggctgatcctttatgtagaaggaaagacaaagaagccctcagagttggaatttggagaacagacatgactaacatggaatttttttttttttttctaaaatagggtcttgcacagtcacccacgctggagtgcaatggtgcgatcttggctcactgcagccacaacctcctgggctcaagcaattctcccgccttagcctcctatgtacctaggaccacaggcatacactgccacactcagctatttttttttttttttttgagatggagtcttgctctgtcacccaggctagagtgcagtggcacaatctcggctcctgcaacctctgcctcctgggtttaagcaattctcctgcctcagcctcccgagtagctgggattacaggcacctaccacaatgcctggctaatttttgtatttttgtagagacagggtttcaccatgttggccaggctggtcttgaactcctgacctctggtgatctgcctgcctcagcctcccaaagtgctgggattacaggcatgagccaccacgcccggcctattttttttttttttggtagagacggggtcttactttgttgcccacatttgtcttgaacccctgggctcaagtcatccacctgcctcagcctcccaaagtactgagattatgggtgtgagctgccatgccccgcctagcatagattttaagttgcttacaatggagtgtaccctgtaacacatctcctcagcatcccccagagaacctgtgttatgtgcattggccttgaaggcttgtgagtcagcgattctttggtggaactcagcatatgtgtctgaaaagacagagcatgtagaagaagaggctcgtgaacaaggaagcagctgtcacctggtcacttacagccagtcagttgatcgtcttctgggtctcaggtcaggtttgcaaaggaacaacacggacctatcctccttctcctcttcctccagcctaaatggactccagccagctgggtgtcactgctgccatccttagagagggcttttcccaccttcacataatcaggaggctcctttcttcccgcaggagcccatcagtcgaagtgcacggctgcttctcgcagagagccttcttacccatcaagggaagataatgctctgtgatcattttggtttttccaggcttcatgttctctctctcctttctgccccagcggaaaacgtagggctgctattttaagacatcctttagtaccaaaataccactttgagacactcatgtctttcttttcaataatctcttttaaggtataaagaacttaccaggaggggcacgtggtggctgcctatgggaagcaagctaaacggctgctcagagacctttctggtattcctgctgtgccaggacgtcagtactttccaactcatgattctgaggctggtggatcttccttgtcttcttccatctctcatcttcaatgtcctaggctggggactaagggaaggcataatggggagcccaggcttcatgcagatggaacaccagcatgagaaaggaaaggcagatactggccatgtggacaagaaagcaagacagaagaacagtcagtgaaaatacctttccctaccatgaccaataccattgagtctatagctgaaggtagcattaggggtgggtgtctagcaatatcatacaaactaacagacatttgggtgaataaatcatgagcagagtcccccataatctgcctttctaacgataattagtatttactgagtgctatatgtcacttagtaaatgaggtccggttttaatccgtttacaagattcagttcatttgctgctggcaacgatcctatagcataagaaccattgttcccctgtatttacgaagaggaaattagagctcagagagggtgagccacttgcccactatcacacagctcatgagtggtagagctgggactcagacccaagcctgaccccagaacctgagctcataacctctccttggatgggttcttccaaggagtctgcctccaataaactgtgtcccatgccagccaggcaccagcatatgctttggagaaaccaactcccgtagacatctgtctagatggtgctgatattataaatggtactatgaaaaaataaggataaagcttataaatcaggcaaagggaagttatgattcttctggacaccctaatctatctccctataattgcctgtatatgaaatgcctgcatgaggttatcagagtattccctgagtcgcctgcgaaggtaagactgcaattttagcgacccttgttacacaaaccaaagcaatctgttctattttgacactatgacactcctggcttgcaaaagggatggaggcacggacgggcaggcatttgtccacattcttgttccaaacgaaagtaagaagggttaactgtgaggcatgcttactgcaaatgacagctctggcttctaactatactaagcagtggccaccaatcttggggatacttaagagaaaaccacagctccatttctttaacccatctttaacctttagttctagaaatcttaattaaaaatcaattccattttttttgtagtaaatctgacagtaattctatctctaatggcagtggaaagataaatagtatgtcaggtaaactcagcaggaaaatgacattttcattagcaatttactgggtaggaaattcccgccatgataaagcattcctgaacaatactaggtaaccattcccctagggcagctgctaattaatgggggaacaccagtgggattaaatgtcttctacccaaatgatttgaatcgtcacagcagttattttgaatgtacctgcaccgagaaaataagtcgggcccccaaaacaataaacaaagtgacataacaagacgattgcagcctattgcagtccagaaaaatctaatctggtctcctaacagcattgcaatctttattgtgactgtatgggccccaattcatcagcccatttcggcaagctatccccaccaataatcattcactttcagggtagcctctgaacaggtattgactttagagactagcaattcatcccgggccctctatccctccatcgagattcttcggcagtctttgaagcagacttggaaagaaaaatttggtcctcatgtgctagacccccagagagcttccagggataaagaaaaaagaagacaagcaaaattctccattcaaaaggagaataaaatcctggcatcatatttcatccctgctaaacctcaataatgttcccagtgatcagtcaaatcaaggtagaatcatgaagtattagtaagaaaagggatgtagggttagagtatttacatttacagaggggctactatatgcccagggctccaaataactttctaattaaaacttacatcaagcccattgcaatgtaggtataattattagctttcctttcagataatgatactgagcaacgccctggctgaatggcggggaggactgaatggtggtgatggccaagagcaaagcgaaacagcatttccaacaggaaggatgtggacaggattatagaccctggtcagagcaccgtgatgaggaatcctacttggcttggggtgctgatgtccacagaccgataggggagagactttatgctgtgtatctcagataaggcaaagggaagatgtaattagattttactatggagtcataatttcagcccacagaaaacaataaaagtgtcaagagggccgggttcggtggctcatgcctgtaatcccagcactttgggaggccgaggcacgtggatcacgaggtcaggagttagagaccagcctggccaataaagtgaaaccctgtctctactaaaaatacaaaaattagccaggtgtggtggcatgcgcatgtagtcccagctactcgggaagctgaggtgggataattgcttgaacccaggaggtggagattgcagggagccgagaccatgccattgcactccagcctgggtgacagagtgagactccgtcaccaaaaaaaaaaagcgtctgaacacagctctcccttttgcaggaatggttacctgatattctcttcccaccaggggcttggctggagctctgaagctgaagtggatgccactccgtatgatttccatctgtacttattaatggtgaataggagtcagttatgtaactggcatgttcatcacttcgtatgctgggccccacaacccatttctgaaagggcttccatagagcctgctgagtgtataatgagactttggttctacttcttgcccataggttgggccaaggatagaaacaaaattgaaatctgagttgggagaaccaaggtatcacttggggatgcagaatatggtccaggagctccacacagttgctgttgggcccttgactgagaaaccggacaattctgaggcttgcccggctcaaccggacatggccgatatgcagagagagagaggaaagaagcagacgtgcatgcagaaaggcagaaggagacatacccctaagatggccatgtgctcctggcctctgaattcccaattccaggctcctgggagatgtggctgaaattcctgcccctgaattctgaaggctgcctacagtatttgttgggttgcttctggttccaagtgccagaaaaatccacataactcaaactagttaagtcccaagggagttgaatggctgacagagctgcaaagaccaggcacaaatggctgcaggtgcccagaccatgtcctcacggttctcctctatctcttctgcccgctttcctctgaattggcttcattctccaagttgggggctcaccaaaactcccagaagttctggctttgtaacagcaatggagaaaacaccccacgttccaagcaggtttagaaaaactgggaggctgaggctcactggatggtttggatcatctatctacctatgaaccaagacactatggtcctccggtcaatccacccttagaactcagtggggagtgagtgaggccccacccagccatgcagactaagagaaagcaaaggaacactgttcaaaggggacagctggatgctgttagcagagaacgaatgctggcaggcaaagagcaggaacatctaccatgtcccagccccacttcaaagaaacccgtgttttaagttactctgagcaggtttctggtttttgtcaccaaacagactaaatatttagaaaaatgtgtccaaagtgctatgtgtatgtgagggggagggaggggaataaaaatgagtaagatagatttcagtggtcaagccctttaccattttgtagggaagataaagccaatatatgtaaattatacatcacaagaaagagcttgtttcaaggggatatagaaccccaggatttcaaaggctgtgatactggctggtcaccagggaagtttctggtggtattaactttgtgtggtgattacagaatggtgagggtttgaaatagggagaatagttccagtcacagaatggtgtcatcaggccaggggcagtggctcacatctgtaatcccagcactctgggaagccgaggtgggtggatcacaaggtcaggagttcaagcccagcctgacaaacatggtgaaaccccgtctctactaaaaatagaaaaatgaggcgggcatggtggcacgtgcctgtaatcccagctactcagaaggctgaggcaggagaattgcttgaacccaggaggcggaagttgcagtgagctgagatcacaccactgtactccagcctaggtgaatgagtgagaatctgtctcaaaaaaaaaaaaaaaaaaaaaaaaaagaatggtgtcaccaaacatttagaggctgacaagtatgaggtatgcatagagatgatcaaacttacccctaaatatctcttgcatctatttctccccagctttctcactgccagcccagtctaatgtctctctcaaacttctgggacatccacgcttgctctatgccaatccaatttccacttgtcaaccagagggatatttggcaaatgcaaatttggtgagaattatgccccccctgcttctcagtgagtttcccattgctctgatgatcaagattaaaattattttccagcatcctcccttctttgtcacgccagcccatctgctcttctctaagttctacaaattctgcaaagcttcagattcaccatggagactgccagaaatgctcctcccatccctggtccctttgcagtgtgatttgttggtgcccttcttgcagatacccccatagggaaggcgatttcacctagggaagttcaaatttccttgtgaagcacgcatactgtcacactgtatttttctttattgcttttatttcagtcagtgaataaatatttgtgtgattatttcattatgatgctttcctctacaacaatgtttcttaaccttgactctattgacattttggaccacgtcatttttttttgttttgtatggggggaatgtggggtgcacgggggggactctcctgcacattgtaggatgtgtagcatcagccctcgcttctatcccctagatgctagtagcacaccctcccccagcagtgacaagcaaaaatgcctctggatgtttcccaaacatctccctgggtaggtgagtaacattgcttctcccaccttgaaaactactgctgtataatttttttctttctttgagacagagtctcgctctgtcacccaggctggagtgcagtggcaagatctcagctcactgtaacctctgcctctcaggttcaagtgattctcctgcctcagcctcctgggattacaggcatccaccaccatgctaggctgatcttttgtatttttagcagagaagtggtttcacgatgttggccaggctggtcttgaactctcacttcatgtgatccatccaccttggtctcccaaagtgctgagattacagggtatgagccactgcacccggccactgctgtataatgtatactataaagtccatgaggaaagaaatcagtccaaagcctgataaacgtaggcctgaggctctcaactccagctgcactgtagaatcacaagagaactttaaaaacattctgctgcatggtctgaccctctatcaaataaataggaatctctgagaaagatggagaggggagattgaagcccaggcgtccaaaggaaaaacaaacaaagcagaaaacttcctaagtacatctcttgtgcagctagggttggtaatctcagaagcaggcatccatggttggaagctttgttgaatgaatataagggagggatggagagagtgagggggtgagatgagaaaggaggagatgcagggaagaaaggcaaaaaggggaagaagggagagaaagaaggaggaaagaaaaggaattgaagccaaagaagggaaaaccaatgtttctcattagacgaggactcacaaaaagaacctggttatgaaagctggaggcctaagttgcgagcacatttgaagagctttgaatatcattttgttgtagctggggtaagcaatgcaaagccaacaaaaatttcagagcaaggatgcttcaagttccaagcagtgttttaagaagtcgagtgtgttacacccagcacaaaataaaccagggtggaaagacccgggaataaactgcattatatgaaataattgagagtggtgagaataaaagtgaaacaacaaacaccaaagattccctacagcaagataacctggtgattatactccctgacaagtgcagagactgccttttggggacacagccttgtccctgtcattcttagtttagtaactaaggcagacagtgaaaaacagttactaatgtcgtatcagtaaggaagaagcagaaggttccacgggctggagcaggtgcctcccctgatctcaggcttcagaaaacacttctcagagggaagcagctataagttagcatacctcccagcggggagggggtgggctggaagagtgagggagggaggtacgggaactaggaaaagagaactggataggggagggtcaagagcaaagtgaaacagtgacagatgagcaagagaagcccaggaggatggtggagtgcctcgtaagccctattcaggattctagactttccgctaagagtcgaaataacccacagagagaagggttttaagcaaagtagaagcatcatccagatttgcatttttttcagatctccttttcgctgtgaaatataaaacagaaacgtggatgaagagagaagctggcaaaatgtttccaaggctttaacgccacctgagttggaaagagaaatgtgacatgagcagcaatgcagagaggcagccagtgaccagagttagggacaagaaggctttgaacattttctcccattttacaaaagcgtttactttctgggcacaaggtccccatgttgggaagagagtggaaagagctgtgcatcattccaggccctgcatattgtgcatggatccctgcctgcctgcaggtgcctgtgcttcagtaaggagaacctgggtaaatcaatcaggactcctttaaactctaggaagtcaagaaattctcctagttggtctctgtgtccctgaagaaactcaacaagaaaagaatacgggctgtgtagccagtctaatctgacttccaatcctttcccaaccactgaccagctagataatttccctaacaactctgagcctcagtttcctcctttacaaaacggcaatgccactatctccctatgtgtttgtgataatcaagtaacaaacaatacttggacagtgcctagaagagtggttggccattgtattcatccgttttcacactgctataaataccctaggctgggaaatttataagaaaagaggtttaaattcactcatagttccacatggctggggaggccacaggaaacttacaatcatggtggaaggtgatggagaagcaaggacgttcttcacatggaggcaggagagagtgtgagcaagagcagggaaaactgccttataaaaccatcagatctcaagggaactcacccactatcatgagaatagcataggggaaactgcccctgtgatccaatcacgttccatcaagtctttccctaaacacctggggattacaatttaagatgagatttgggtgaggacacaaagcctaaccatatcagcagtgaataaggactggtgttctccctttgaatgaaggtatctaaactatgtagattaatcaccagcttaagctatttgctgctacaaaaaactgcaccatgaacagccatgtccacgatgtagcattaattcaaaatggtgcatgtggggaaggtttagtggaaaggctctcccatttgcttatgatggatgtttataggatacagaaaaaaatgcaggactccaggcaatagaaatatttgaataacagcacagccggaacatttgtagcaggtcaatagactgctcctctctccagtaaattccccatcttgagcttctataatattggcatctttgttatgaagcaacttctgatctatttctcttctggaggtatagtgaatgcatttgaaggagaatggtgctttattacagaccaagggccttgtgtttatgatttataatattgtggtgtttgcctgcctaatatcgcctaaagaagtgacaaatcatgcaaaagaaattaacttgccctgactccgggtctgtttgtttagccaggactcttcagattgcaagcgacaggcaaattaaaatagctaaggaaaaagagaattgtaagggcatggaggaatctcatgcaagaatggaatgaccaaaccaaaaaagggcaggaatgcaggtggggctcaggaactataaaaccacagactcagacatactggcattcttttccatttcttgtagcaattgtctgtttctttctttttttaaaaaaaaatctctctcattacaaatggtctttggctatacagaagaaaaaaaagtgtctcttctgatctcagtagcttctgagttttctatttatgatgtcagtcctcagagggatattgagtttactcccttgatgcttagcccagaagtcctgatggagggacttgttggcttagcttgggtcaggtgcccattcttgggccagtcagctgtttccagtgcagcgtggtgacccattctgggtcagatacctactcatggaccaattgacattggctagagatgtagactacttgagaaaatggtccctcaaaagaaaaccaaacagatttgcaggtggaggaggaatttccagaaaaagagccaggttggagagacaaaacaatgggtgaatgctacacctctctcctgggggtggtcacaggaggactctctggtcttgaattttactcacttattcttctcctccttattcattcattcattcaaatacttactgaagtacttcctgccgttttctgagtttagtgtgaatcaaagttctcccctcctactgctgacacatttcttttttctttttctttttctttttttttgagatggagttttgcttttgttgcccaggctggagcgcaatggcgcaagctcggctcactgcaacctccacctcctgggttcaagcgattctcctgcctcagcctcctgagtagctggaattataggcacatgccaccatgcctggttaattttttgtatttttagtagaaacgcagtttcaccatgttagccaggctggtcttgaactactgacctcaggtaatccacccacctcagcctcccaaagtgttgggattacaggtgtgagccaccgtgcctggccgctgacacatctctaaagcacagacacatccactcatagtcttccatcaacgccttggccggagaggtgctcagtcccacttaatagtgggcaggagcttgcagaccacttcacactaatgattcctcctgctcagagatctattctccttgaaatattcagcaatgcacagacaaattgcagacagatcatcccaatctctcaatagtgacacacatacacacatgcacatatatgtgcaattgcacgtgcgtgcacacacacacatacagaggccagaatctctactagatattgagaaaacacttgcttttctcctgcagaataaaacatttagctgaccaaggtcacttttgtattgtattgacgggcctgcaaatggagacgtacggtattaggaaacctcaaatctggtataaatttatgggtcttccttgaacagagttatctcttctttgtccttgagcttttttcatttgaaaagtgaagagcctgaatatgagctagatcctcgcaaccagttttggaagggaaacaccaggtcctaaattgtcaaaactgaggccttatcgaggactctttctctgacattccaggttgtatctaatgaccaaattcttttcttttctgtagtagttccgggtcgtaagcatctttgcttacaggtaagctcccagttaccctgtaacatctagaaagcagacaccagggcttattcttcatattacagatgcccagcacagaacctggtatataacagacacttggtaaatgtttgttaaataaatggactgatgaaagacacattgtgtgggccaacctcacttgtccacggagggatcctcctctcagcaaatagtggctacaatgactttcgcattgtgagtctgaagaacagagagctcaggctgtcaggtcccacaaaggccaccagaattcacatctcctttgacgttctccagagctgggtcacagagtctcctggtccaccaaggatagcagaagctcaagaacagcacactcaacccagtaatacagagagtagcgcaggctcttcacaggcatttaaaaaaatcttggctgggcgtggtggctcacgcctataatcccagcactttgggaagccgaggcgagaggatcacgaggtcaggagatcgagaccccagtgaaaccccgtctctattaaaaatacaaaacaattagccgggtgcggtggcgggcgcctgtagtcccagctactcgggaggctgaggcaggagaatggcgcgaacccgggaggtggagcttgctgtgagccgagatcacgccactgcactccagcctgggcgacagagcaagactctgtctcaaaacaaaacaaaaaaatcttaacagttaccagctactgagcccttatggtgcaccaggcaccatctaagagctttggaaacattttctaaactagtagttctcaatcagggctgattttgccccctaggaaatatttgacaatgtctagacactattttgattgtcatcctggaaggggtttgctgctggtatctaggtggggagggtagaggccaaggattccagtaaacatcccataatacacaggacagcccccaacaacaaataatggtccagccccaaatgtcaaaagtgccaaggttgagaaatctaagataatcccttccacaaccctattcttactataatgtttaccttagtagaattcaggctcttctcaacctcctcacctggtggtctttcattagctttacaaagatgatttattttgggggaaagggctattatcattttaactatagactcaatgtctcccaagcttagcttggtccaagcccaggaattattaaaggcagttgggaggttaaaggcaacatgaaggttggttaggtcagatctctttcattgccataactttctcaccattataatttttgcaaaggcagtttcaactccacagcacagaaacacctttatcaggacccttgcaaaccttgcccctctacctatcacttcatccagttgttcatttgtatcctttataataagacagtaattataagtatggtactttctgagttctgccagttattctagtgtgggggccgtaagttcttggttccctaaaggttcactgaaaaatcattttatgcaggagatgagagaggagaaatgggtcatgaaacgtgtcagcagtaggaggggaagtacatttcctgattttccaggagcagaaactgaggaatatggaatttgcccaagtagcagagctggaatttgaaccctcagtctttcgggtctaacccctaggcgttcaccctctattctatcactcctggcaggtcttgcctataaggttgaactaaatggagaagttcatggtaacaatcctaaacctacttaatatgctgggacttgacaatttccagttgcctccacgtcagattttacctagtttcatgtgagaaactaaagatgttacttgggccagagctggaagtatcttatattgaatccagtttgccctattgaaacataataacttttaaagtaatctagtctcttcattaccgtgttccatccagttgtcgaaatctcttttgagttggtagttaaaaggcccagctacacattcgtaacatcattgttgctggctaaaatgcttagcaacaacacaaacatcactcagaagcaaattatcagatgtaccgacaagatgctcctcaatttaatagcgtggtaaatgatggctgggagatgttctttgaagctgtgaaggcaaatgtgaaagctaattcaattctcaaatgaataaaagtgagaaagtgttcttataaacctgatattaccagagatagggcttgagcatcctgctgccttgtgtgggagaagagagaggagtgggaatttattttatttctgatagtaaagagctgggctgtgcgaccacacgtttgaccttggatcccgggctgggaacttttgcaagcgtgagggctcctttccaactgagctaacaggcatgctgactaaatcgctggttccccttgtagctgcttgagggagtgaggggtctctaaagagaccttcagggctttggggaaatctgatctctattagattttgggaacacagaagataattttctgagaggagaggggatctcatatcacctgggtcagtggctttccaatcgctaatagggccctaggtcttcacaaaggtaactcagaggaaggagaaggaaggcttgaaagggattcacggcctgaaatttgctatcatttattatatatatcaggtttaggggtaagatattattaacattaatattaagatataacaaaggcttctactgctaaaaatcatgaatgccactaatctactcacttagacgagaaaagctgggctccatggagatgtccccaaggccacacaaccagctaagggtcacaacccaataccaaccgggtgcccaagaattcatttcatttctgacactaattacctgaaattaatgtccaacttcacacgttagggggctcagcaccacaaacctgcctgcacttcagatgctgccgcaagccccaggggccatctacacttctgcttggccaatgcggccataaatttggggattcccatgaccccctttcaggttcacaatttgctactgaagcaaattaaaatattttaccctgaaatatatttctctgacatattttgaaatggctttctcagagctagcagattgaggtgggggtaaatttgcatctgtagagaatctccattaatgtagccaggtcttttctatacctttccaagatgtaggagagactgagtctgacacctttaaaagactagaaaggctgatcacaaggtcaggagtttgagaccaccctggccaacatggtgaaaccctgtctctactaaaaacaaacaaacaaacaaaacaaacccccaaaaattagtcaggcatggtggcacatgcctgtaatcccagctactcaggaggctgaagcaggagaatcgcctgaacccaggaggcagaggttgcagtgagcctagatcacgccactgcactccagcctgggaaacagagcaagactctgtcttaaggaaaaaaaatgtcttaaaagagctgggcatggtggctgacacctgtaatcctaatactttgggaggctgaggtgggaggataactggaggccaggagtacaagaccagcctgaaaaacacagtaagactctgtctcaaaaaaaaaaaaaagagagagagagagagagagagaaagaaagaaaaggaaaaataaaaaactttaacttgaaaaaaaagtcaaaaaagaaatttttactatctattctcttggagggaggcctcctccacataacaaggccacctttgctagccaagcctcttcctctcttcctcccgtaaacctgtcttgccactaagcctgtttttggccatgctctaagtccacactctttctgtaatctcaagcttctgtaacttattgttgggttaggtcttcattctgaaggctcctgtgtatacacattaagcacatctgtatgccttttctcctgttaatcaatctgtctcatgtcagtgatttttcagtgaacctttaggggccaagagcttatggtccccacactagaatagctggtagaactcagaacgtgctatacttacaattgctcttttattatcaagaatacaaaccgggtgaagtaatatatagggtggcaaggtttggaaggctcctgataaaggtgtttctgtgctgtggagttgaaactgcctttgcaaaaattataatggtgagaaaattatgacagtaaaagagatctgacctaatcaaccttcatgttgcctttaacctcgcaactgcctttaataattcctgggcttggatcaagctaagtttgggagacattgagtctatagttaaaatgataatagcgctttccccaaaataaatcatctttgtaaagctaatgaaagatgaccaagtgaggaggttgagaagagcctgaattctgctgagatatagacataaatgattaccagccattattctggaggtcatacgattttcaattccctagttactcctgcagataagatcactattgttgaccctaagattggccttttgagatgtcttttcaggtttttgcatttctgataaccaaggactctaccagacctgccaaccagtcctgtggcctctacccagtaaccaactcagcacaagaagaccgctttgactatgtatgattttatccctgacccaaccaatcagcactcctcacttcctggccccgttcctgccagaactatccttgaaaaatcccagtctctgaattttcagggagcttgatttgtaataactccatccccctgggggatgaccggcctcatgttagctaaatgctttatttattgtgatgctgcggtctcagtgaattgggtttgcctgtgcagtgggcaggaagaacccatcgagaggttagagagtgacgatgcggccaggcatggtggctggcgcctgtaatcccagcactttgggaggccaaagtgggcggatcacttgaggtcgggagtttgagaccagcctggccaaagtggtgaaaccccgtctctactaaaaacagaaaaagttaacttggcatggtggtaattccacctgtaattggaattggcacctgtaattctagctacttgggaggctgaggcaggagaattgcttgaacctgggaggtggaggttgaagtgagccaacattgtgccactatactccagtgtggatgacagaggaagactctgtctcaaaaaaaaaaaaaaaaagagtcagaacacacctccctgccagcacatcagtacacttaccaaccagaaagctctcagagcctcattgcccagagtttttgttgagctttcattatataggcatgattgattcaaccatgggccacatgactgaactcaatcatctccacctccccacccctagccacaggttggggcggaaaattccaatcctctaatcatgcacttagtctttctggcatggccaacttctccttcaaaactaattagggtccaccatgagtcacctctttaggataaactcaggtttagtaaaaagagactcattttgaataacaaaatatactcctaacacgtaagaaattcctaaggcatttgaaggagctctgtgtcaggaaccagggacaaatatcagatttaaaaaaaaaaaatcataccataaaggcagaggctgacactatatatagcgcttgtttttttctgtcaccccagcaatccgactaggtgttttctgagcaatgaaagagcagaatatattggtcagagcaggaggtacctagtgattggctaatttacagactaggaaaatgtgattcagaaatgatgggagggccccagctacgtggtgatcaacctggtctaaaagctgggtgtctaaccctgaatggcaagactctgtagggccccctgcttgtttcctatggcttctgtaacacattgtaacaaacttactggcttataacaacacaaatgtattagcttagagaagtgcaggtcagaggtctaaaatgggtctgtgaggctgcgttccccctgaggattctgggggggattctagtcccttgcccattcccatttccagaggctgccaccatcttttttctcacgacgccctttctccatcttcaaagccagcaacacaggatcttcagatcattccctttccccctctccttctgttgttacactgccttctgtctaactgacttttcccgcatccctctcttaagaagtctatgactgtaatcccagcacttcgggaggccgaggtgggtggatcgcttgaggtcaggagttcgagaccagtctggccaacatggcaaaaccctgtctctactaaagatacaaaaaattagccaggtgtggtggcatgcacctgtaatcccagctactcggaaggctgaggcaggagaatcgcttgaacccaggaggcggaggttgcactgagccaagatcatgtcattgcactccagcctgggcaagaagagtgaaactcaatctcaaaaagaaaaaaaaaaaaaagcagcctgtgattacatcaggcacacagggtaatccaggataatctccccatctggggattcttaactttatcacatctgcaaagtctcgtttggcttttaaagtaacatattcacaggttctgggcattaggacataggcatctctgggagggccttgttcagcacaccacagttgtatattttcaccctttcaggcatgaatttgctaggtttcagctcctgcttttgttccttcacaaatccctgatgactactattgaggaggaagggactctgtctctgtctcctttctccaacttgtttttttattttattttattttattttattttattttatttttttaacagagccccttcctacttttgctggcaaggaatgaggtgctgccctttgaccatacaaggtcctacttaccagaggtgcgagcagtacctttagcactgatatacatctgtgggcacttccttatcgtcctacccgccttgtgtctgccagggctgtgttgctttcctggtcctccttcatttgtggggaggaggtttataggatgtttggaaatattgttccatcatctttgttctccaactcagctcttaccagaggcccctgtaaaacaaatctttacttttcagctagataagttggtgctttatttcctacttggacaatatctaatcattcagaagagataattgtgtacccaagcctcatttacaaacccatttctcccctctcatctcccactgctttgctgtgtgagctgtagggatttactgtcctctcctttttttcaaagtaaaagatagagtggctccagtgagaaatatctttacccccatgatctgcataggtcagtggttttcaatccccaagggcttcccccacctccccagggatatttggctatgcttgaaggtgttttggtggtggcaacttgggaaggggattgatgctggcttctagcaggtagagaccagagatacagctaaacattcatcttacaatgcacagaccaccgccctgactacaaaagagaattatctggtccaaatcaacactaacgcttctgttaagaaatcctgacttagggccaaagagcaggaaaaaacattgcaataagtttagtctctttccctaccaatttacttgatcctctccataggagatttgggactattattgcagcacattaataaacaggcagggtctgtctttgtgcttccaaagcttcaaacacaagggcttcctctggtcttgtctgccctcgcacacagcaagtcttccttctcccatcctattgcctacccatgcagcaaaaataataagcaggacgctcctgctgaggacaggaggagtgaggggagattgcctttcactgattactgaagcctgaacttaaagggcctgaaagtgagggctccaaaccagttctgaatgctttgctgtgatttgtactttggtgtattggtaacttgagtgcgaagcataaacaaggatcagtactcagggccatttcttgatttttataatgtcttccaggccatggggagggcaaggctctagttgcagccatgtaaagctttaccttaagtagagctttaccttaagtaaggctgtaagccacaggggcttggagaaatctacagtagatagcagtgaacaagacttcctgggactctatctcagcttgtactgagtgactgctatatgggcaagtcaggtcctcaagccaaaaaacagatggccaaagggaatttttatgctggattggagcagaaaaatcctgcttcttcctatgacagaaaaaagagagagagagagaaaaaaggccactgcttcttaagaggtaagcctcatatgtagttataaaggataattcttcctttaaatgcaaagaaaaataattttaaaattgcttcattgatcgaaaaataactgagtacaaacaagtattcacaccacaaaaggcaaaagccttttttatcttaacgagaatattatcttgttacagttaatagttattggattacccattatgtcccaggcactatttaagggcactgcaaatatattatctaatttaatcttcaccctaactctcagtccaaggttattacatcaattttatagataaggaaatcgagagagagagaggtaaaatcacttgcccaagatcacacagctggtaaagtggcagagaaagaattttgaaccgagatttggctgatcaaatgatcccttgtaaaccctgtcgtattttttttcagatgaatcctccatatttgcattctcacactttattataagagtgacctaaattccactccagtttattttttttgtaatgtcttttatcggttttggtatcagaaaaatgccggactcatacaagaaattgggaaatgtgttttccttttcaaatttctggaagagtttgtgcagaaatgctgttaattattattattattattattattattattattattattattatttttgttgagacggagtcttgctctgttgcccaggctggagtgcagtgccgccatctcgggtcactacaatctccacctcctgggttcacacctttctcctgcctcagcctccccagtagctgggattacaggtgtccaccaccatgcccggctaattttttttatttttagtagagatggggtttcactgttagccaggatggtctcgatctcctgacctcgtgatccgcccaccttggcctcccaaagtgctggggttacaggcgtgagccaccatgcccggcctgctgttaattatttttaaaatgtgtagaagaattcaccagtgaagccatctgagccaaaaattttctttgtggaaagtttttaagctacgattcaattttctttaatggctatagcactattccggtgatttatttcacttaagtgaggtttcattgttacatctttcaagagatttatcaatttcagttgtcagtgaatttatagacacaaagtttataatattcacccaagtatccttttaaatatctgtagaatccgtaatgagattacctgtctcatttttgatattggtatttgtgtcttccttctttttttctgatcagtagggctagatgtttatcaattgtttgatctcaaagaatcagctatttgctttttttctatttcatttggttctgctctgatatttattatatctattcttttgcttattttgaattagtatgctttcagtttaccttgcttttcactttctatttttctaagatggaaactgaggtcattgttttgatacatttataattttctaaggtaggcatttagtactacaaatgtctccctaagtactgctttaatgacaatgtacaccttttgttgtattttcatgtacattcacttaaaggtatcattttcccttttgatttcttctttgacctatgggttatttagaatgacgcaattaagtttccaaatatttgtttttttccagggatctttcagtcattgatttctcatttaattccattatagtcagaaaacagtttggatgacttgaatccttttaactatattggtgcttgtattttggcttttgtattctggcccaggatatagtctatactgataaatgttctgtggagacattcaaaacacactgaaaagaatgtatattccactgctgtggaagggagtgttttataaatgttaattcagtgaagatggttaatagtattactgaagtcttctatatccttgctgattttccattgacttttctgtccattactgagacaagagtttgaaatttctgactataattgtaaaatactttttgcatttctattggtttttgcttcatgcattttcaagctccaagtaactgatccccttattaaggaaccttctttattccttgctgtgaaatctactttctctgatattaatataactactcctgccttttataaaaagtatatgcatggcatatctatttctatccttttatgtttaacctatttgtgtatttacatctaaagggcacttcttgcaggcagcagatggttaggtcttgtttttgaaaatatccacattgacattgctgccttttaataaggatgatcagaccatttaatatgattattaatgtagtttatgtctcatcttgctatttgtttttcattagacctatttgttatttgtttctctttccttctattccttttttaattttttaaattaagttctggggtatatatgcagcatgcaggtttgttacatagatatacacatgccattgtggtttgctgcacccaacaacctgtcatctatgttaggtatttctcctaatgctatctctcccctaaccccccacccaccaacaggccccagtgtgtgatgttcccctccctgtgtccatgtgttctcattgttcaattcccacttaggagtgagaacatgtggtgtttggttttctgttcctgtgttagtttgctgagaatgataatttccagcttcatccatgtccctgcaaaggacatgaactcatccttttttatagttgcatagttttccatggtatgtatgtgccacattttctttatccagtctatcattgatggacatttgggttggtcccaagtctttgctattgtgaatagtgtcacaataaacatacgtgtgcacgtgtctttatagtggaatgatttataatcctttgggtatatacccagtaatgggattgctgggtcaaatggcatttctggttctagatccttgaggaatagccacactgtcttccacaatggttgaactaatttacactcccaccaactgtgtaaaagcgttcctatttcttcacatcctctccagcatctgttgtttcctgaccttttaatgatcaccattctaactggtgtgtgatggtatctcactgtggttttgatttgcatttctctaatgaccagtgatgatgagctttttttcatatgtttgttggctgcataaatgtcttcttttgagaagtgtctatttatatccttcggccactttttggtggggttgtttttttttttttttttttttgtaaatttgtttaagttccttgtagattctggatattagccctttgtcagatggatagattgcaaaaattttctcccattctgttggttgcctgttcactctggtgatagtttcttttgctgtgtagaagctccttaattagatcccatttgtcaattttggcttttgttgccattgtttttggtgtttcagtcacaaagtctttgcccatgcctatgtcctgaatggcattgcctaggttttcttctagggtttttacgattttaggtcttacgtttaagtctttaatccatcttgagttaatttttgtataaggtgtaaagaaggggtccagtttcagttttctgcatatggtctgccagttttcccaacaccatttattaaatagggaatcctttctccattgcttgtttttgtcaggtttgtcaaagatcagatgttcaacatacgtgcaaatcaataaacataatccatcacatacacagaaccaatgacaaaaaccacatgattatctcaatagatgcagaaaaggccttcgacaaaattcaacagctcttcatgctaaaaactctcaataaactaggtatggatggaatgtatctcaaaataataagtgctatttatgacaaacccacagccaatatcatactgaatgggcaaaacctggaagcattccctttgaaaaccagaacaagacaaggatgacctctctcaccactcctattcaacatagtattagaagttctggccagggcaatcaggcaagagaaagaaataaagggtattcaataggaagagaggaagtctaattgtctctgtttgcagatgacatgattgtatgtttagaaaaccccatcgtctcagtccaaaatctccttaagctgataagcaacttcagcaaagtcacaggatacaaaatcaatgtgcaaaaatcacaagcattcctatacaccaataatagacaaacagagccaaatcataagtgaactctgactcacaattgctataaagagaataaaatacagagccaaatcataaatgaactccgattcacaattgttataaagggaataaaatacctaggactacaactcccaagagatgtgaaggacctcttcaaggagaactacaaaccactgctcaaagaaataagagaggacacaaacaaatggaaacacattccatgctcatggataggaagaatcaatatcatgaaaatggccatactgcccaaagcaatttatagattcaatgctatcctcaagataccattgactttcttcacagaattaggaaaaaactactttaaattttatacagaaccaaaaaagagcccatatagccaagacaatcctaagcaaaaagaacaaagctggaggcatcatgctacctgacttcaaaccatattacaaggcaacagtaaccaatacagcatggtactggtaccaaaacagatatatagaccaatggaacagaacagaggcctcagaaataatgccacacatctacaaccttattccttaagagtattttacaacttcattttttataaaataagttttattgagatataactcacatactatcaaattcagttttttaagtgtacaattcagtgggttttattaaattcagacttgctcaacatcactactatctaatttcaaggcatttttctcatcccccaaagaaatcccatacccattatgcagttattcttcttttccccttatcccctctggcaaccactattctacattttctctctttggatttgcctattctggatattttacattaatggaatcataaaatatgtgagtttttgtgacagtattcttttacttagcataatgttttcaacgttcatctgtggtatagcatgtatcagtgcttcatgcctttcctttttgtattccttttattttttatttgcattccttaatattcctttttgtatagataggtcacattttacttttttaattcataagttgatgaacatttaggttgtttcaattttttaagtagtgtgaataatgttgctatacacattaatgtacacatttttgtgtggacatatgttttcagatctcttggatatgtacctaggagtagaaatgctgtcatataaagccacgtttaacagcttgagaaattatcaaagtgctttccaaagttcctgcaccgttttacaattccatcagtaattaaggttctaatttctctacattctcaccaacatttgttattgtctgtcttttaaaaaacagtcatcataacaggtgtgaagtaatattccattatagcttagttttgagtttccttaatgattaatgatattgaacaacttcttgtgtgcttattggccatttatcttttttgaagaaatgcctactcaaatcctttctccattcttgaattgagttgctttaattgttgagtcaaaagatttctttttattatacattctggatacaaagtccttatctgatacagaatttgtaaacattatctcccattctgtggtttgccttttacccatttcgatggtcttttttaaagcacgaaagttttcagctttgatgaagttcaatttatctattctgtcactcatcttttttttttttttggtgtcatatctaagaaggctttgcctaccacatgttacaaagatatacgcctatatacttcctaggagttttatattaactcccgtatttaggttgataacagatcttgagttaatttttgcatatggtatgcaaaatttattcttttacctgtgagtatcaaattgtccaacatcattcgttgaaaaggctgttcttttcccattaaattattttggcacctttatcaaaaagtaagttgactataaacgtaagagtttattttgaggctgggtgcagtggctcatgcctgtaatcccagcacttcggaaggccgaggtgggcagatcacaaggtcaggagatcgagatcatcctggctaacactgtgaaaccgcgtctttactaaaaatacaaaaaaaaaaaaaaaaaaaaaaaaaaagccaggcatggtggcaggcacctgtagtcctagctactcaggaggctgaggcaggagaaaggtgtgaacccgggaggcagagcttgcagtgagctgagatctacactgcagcctggggtgacagagcgagacttcatctaaaaaaaaaaaagagtttattttgggactgtcaattccattccattgatctgtatgtttagccttatgccagtaccgcattgtcttgattactacagctctgaagcaagttttgaagttaagaagtgttaagtccaactttcctctttcaagattgttttggttattctgggccatataaaatttctaattatcttgtcaatttctgaaaaaaaaatcccactggtatagtgataatgaaatgggagagttccctgacccccgccccatctcaggacctgtgacaggggtgtgactcgtcttttcagccaccacctctgttcaaaccccttatgggagggggagtatgcagacaggcaggtgcaggagctggggtgagcacttctgggctttggccccatagtagcatctaggagtgggtgcctacaactcccaaagcccaagtgggcatgtgttatagtgcactcttttagctttgccatccgtggatggtgtaggtgttaaacagctcagtggaccctctgccttttcacgagggcagagggccagtgcgacagttttctgtatcccgagctcttgtccagcatccaggaaaaatcaggtcacacaacgactcgaaggatggtgaatgcaggggttttattgagtgatgggggtggctctcagtgggatggatggggagctggaaaggggatggagaagatgatcttcccctgcacattggctgtccagcagccgatctcctctctgaccatccccagctgaactcctcttgatgttcagacattccttttcttctctccttctcttctgttcttctgctcttctgttcatttgctcatctgtgcttggagcctggggtttggggtttatgcgggtatgggatagaggggtatggtgggccaagaggcaacatttgggtacaaaaataagaatgcctgttcccatttagggccacaggtttccaggcttgagggtggggcctttgccggggaactgtcctcttctacctctgtctcctgtctgtatcagtgagaattgaatgaaatctttagatcattttggagagtgtggtaggtagaattatgacccccaaaagtatatgtcctaaactctgtaaactgtgaatgtgttatcttacatggcaaaagcaacattgtagatgtgattgagaatgttcatcatgatgggctcaatgtaatcacaagtgtcttttataagagggagaaagaacggtagatttagagaaggagatgtaatgaggaagtagatatcagagtgatatagtcccaaactataccacctggtcccaggatttaatttgtaggattttttttttataagcctcagcatcccaagtatctgggattataggctcctgccaccatacctggttcatttttgtattttaaaaaaaggaatctgtcgattttacatagattatctaatctgttgttatacatgtgttcacaatatttgaattctttttatttctgtaaactcagtagtaatgttccctgtttcattcctgatttcagcaatttgaggctaccccctttttcctcggtcagtcaaagttaaggcttgccaatttttttaatctttccaaaaatcaatttttgatttattgactttctctactgtttttgttatgctctgtgttatttatttatactctcatctttgctatttttctccttctgcttttttaggtttagtttgctctttgtcaaatgaatgagccacagatggcctctgcatattagcccctaggttgtttgtttcttcactgcaggctgagacctgttagctcaaaacccctccagcatcaaactcaaatttttacgtagccgtttgttttaaaaatagcccaaacaaatagctttgtagctatttagggtctgtttgctttgcatgccctatgaaatctcattttgcattggtattggctaatttatgtcctcccaaaattcatatatttaagtcctaacccctaatacctcagaatgtaagtgtatttggagatcacacctttaaagtggtgattaaggtaaaataaagtcatagggtaaactctactgtaatccaatatgtccgtcatccttataagaaaagaagactaagatacagacagaacaggctaaggaatgactatgtgaggacatggtgagaaggcagccatttgcccagcaaagagtgaggcctcagaagaaaccaaacttgctgacatcttgatcttggacttctagcttcgagaacctctgggaaatacatttatgtgtttcgtttgtttgttttgttttgttttgttttgttttgttttgtttgagacggagtctcgctgtgttgtcccggctggagtgcagtggcgccatctcggctcactgcaagctccgcctcccgggttcacgccattcgcctaagcctccagagtagctgggattacaggcgcccaccaccacgcccggctaatttttcgtatttttagtagagatggggtttcaccgtgttagccaggatagtctcgctctcctgacctcgtgatccgcccgcctcggcctcccagcgtgctgggattacaggcgtgagccaccgcgaccggcccatttctgttttttaagctgttcagtctgtggtgttttctgatggcagccttagcaaattaatacccacatctgctagcaatggataagataaagccttgtagttataagactccaagctgctactgctcttgggagctttcagatgtaaagacggcctgctataatactgaggatgttacctacatatgtaaactctttctccccaacccccttcttcctagaagtaaccttgcccccatttcctttagaatggtggcctcctaggattaaacctcgggaatgtctcatgttgccagcaacttcctctcctaggcaattctgtcaaagcaccaccttataaagcctgtgtgttactgtcatggacagccctgaaactccttgaattctaccccgacactcctttttactctagctttttaaggtggaaggttaggcttttaattggacatcctcttctcctcttgaacaacaccctttttttcaagaatacctgttcataccatatattcctctctgaacactgatttaggtttatcccataagttttggcacattgtggttttattttcactcatcttaacgtattttctaatctcctttgtgatttcttctttggttgttttaggagtatattttaaaattccaagtattataaaatttctaaatttctccctgttaatgatttccaactgcattctatggtagtcagaaaacattttgtattatttcaatcattttaaatttattgagacttgttttgttgcctaacgtatggtctatcttggagaatgtttcatctgcacttaaggaaaatgtgcattctgttgctgtggggtggaacattctatactatctactagtattgttcaagtcttctgttttcttattgattgtttgtgtaattgccctgtccattattaaaagtgggtattgaattcttcaactattattgctgaactgtcaatttctcttttcagttctattagttttaaaatatatttctggggtctctgttgttaggtatatatgtattgcaacttttatatcttcttgatggatagacccatttatcattataaaatatttttgtctctagtaacaattttttgtcttaagtctattttgtctaatattagcatcatcattccagctatcttttgatcacatttgcaaagcatatctttttccattcttttattttcaacataccatgtctttgaattcaagtatgtatcttattctcagcatatagttggataatgctctttaaaaaatctattcttccaatctctgctttttaatattaatatttccttttaatgtaattattgctatagtaagatttatgcctaccattctgatatttgttttttatgtgtcttatgtcttttgtttataaatttcctccattactgtctcatatgaaatcgttattttcttgcacgatattttatttcccttgtcatttctttacacaccccccaccaccgcacacacacaaacacaaacacataaacatatacctacatgcattttagttattttcttagtggctgtcttggagattataatcaatatcttaatttataataatatagtttagattaacctcaatgtattataatagcacataaaaattttgctcctatatagtttggttcactttctttgctgtgttatcatactaattacatctttatgctttctatacctgttaatacagatttataattattgctatataaagttgtaaatcagatatgagaaaataaggctgacaaacaaaaacacatttatattgtcttttatatttacctatgtagttacttttatcagcattctttatttcttcatgtggatttgagttactgcttaatgtgtttaatttcaacccgaaagattccctttagtatttcttgtaggacagatctgctagtgacaaagtctatcagtttttgtacatcttggaatgtcttcatttctccttcatttttaaaggacagttttgctggatgtaaaagtcttggttgacattcttttttgtattttcaaatgtcacctcactgccttctggactacatggtttcgggtgagaaataagctgttaatctaattgagaatcccttgtatgtgatgagtcacttctctcttgttgctttcaagattctctttgtttttgtcttttaacagtttgataatgttttatgtgtgtatctctttgtgtttatcctagctggagttcaccaaatctccaggacgtggaaggatgtaaatgtatgtttttcatacaatgtgtgaattaagaacatgatacatttaaacgttccttctgcatctctctctctctctccttctgggttatcagtatgtgcatgttggtatatttgatggtgtcccacaggtttctaagtcttttttcttctttttttttcattcctttttctttctgttcctcagactggatagtcccatttaaactattaatactattactgtatttgagtttactgactattccttctgtctgctcaaatgtgctgttgactcctttttgaatatttcacttcagttacagttactttcagctcaagaattttaattctttatattgatctttctttattgatattctctctgtagtgagatactgctttcatattttcctttatttctttagacatggttttcttcagttctttgaacatactcaagatagcttatttacagtgtttgccttgtaggcccaacatccgggcttcctcatggacaacttttattgactattttgtcattgcatatattgtgtctggttctgttcttgttggttttagatgttttcaaactaaattgtattaatgttattttatcttgtttgaatgaagaattgatgatgttcaaaataaattttcaagatagttcataagacacaactgggctgggcatggtggctcacacttgtaatcccagcactttgggaggctgaggtgggcagatcacttgaggtcaggagtttgagaccagcctggccaacatggtgaaaccctgtctctactaaaaatacaaaaatcagctggacgtgttggcacgtgcctgtagtcccagctacttgggaggctggggcaggagaatcacttgaacctgggaggcggagggtgcagtgagctgagatcatgtcattgcactccagcctgggtgtcgcagtgagactcagcctaaaaaaaaaaaaaaaaaaaaaaagacaactgtctgtgtgctatttgttcagtctctgttagtgcactgcatccaaacaacaacaacaaattagtgagtcatcaacaagaattagcagctatcaacagaggaaaagttgtctttttacagaaggataaggtggaggacacaaaccatgcaagccaagaagctaatctagtaactgtgattcttttctctctccctttctctaagcccacctcaactgatcatctgatcgctgaactgaggcatagttaggccatgggaggggccatgaagatatatgtgaaccttaccaatctgggatatgttttcaaatgatgatgaagagtaaaattctagcctcagcatctcctttggtgaattccaaaaaaagtccattgatctttcagaaaaaagaccttgatctgaataaggaggtggagaatctcagaaatctccctggagaactgggaaatatgtaaggaataaagtagacagggtctcaatgggagtaggtaggggcaagtagaagaggaagaaagtaatgaataatctcagctccttaaactcttttctcattgctgattcagccctttctttcctattctctctttccatcttctgatttgtttaaccattcaacaaaattacactggaaatggaggatgtggaggtaaacaaaaccaactcactaaatagcaacaacagcaacaaaccaatccctgccccagtagagcttacagaccttaattaaataaactttcctatttaaaaagtgctacaggggcatacaagagcttataacaaacagatggcctagatttactatatcggggggaggaggttgacaacagagtgacttgctcagagagcagaaatgtggaagaaaaaggagggattaattcaatgaagcaggtgaggtcaacacttcatgcagaggtacccaccacgcataggccaggaagcaagaaactgatttcagtcctgactccagattttcatcccagagcatgttgggggattggaggaagagatctttgtttgtcaccatgatcttggaggtcttgacatgatgctggagtcatggggggcttgcttgcttgcttttggaagccaaatgtctgtctctctatcctcttctgactctcaccccaacccagatcagtttctgccacgcagtgggtccaaccagtgcctggattcagttcgctggcccctagcatgtgaattgactgacattcttgagcacattattttttctctaattaggcagtatacctgtactgccagtggcttctcctgagcctatggagccacaggaggtcacattaacagtcttggtataataagtcattgccatgcaagctgaaggcaattaatcctaaaatttggaactgttcgagattaattccactaaactatattgtgaaaccagggcaaaaaaaatatatactaccatttatacctggtgctttttgtttcatgacctcatttacttcttaaaaccaacatttcaattaggcagtattgctattttccttttcaaatgaagaaactatgcccagagaggtctgtggaactcacacagcatcagtgctagagttggcatcctagtccatgactaagttctttctgcaatcctatgtgagttatgcttctggtactctgcactgtatttcacactcaaaacttaactattattatctcattatcaccagagaattgatgcagcactctgacagctatgatttcttttcttttttttcttttattttgtggtctctatgtaaataaaatcttttcaccctaatggctgtcctgacactgccaaatctctgatccacggggagacacagggagtctctgtccagagctatcttcctcccagaagagctaacgaggaaaaaaagtaacagaaggtaacttgctgatcctaattactttgcccgttgtacatgtctcagatcaaataccattttgtcctctttttcccctttagggagaattaattaagctctaattacatcgacagaaaaaatagaagctacaataaaattattttttttttaaaaaagctattaacaaggtctgagcacagagcttgttataacctggggagtgagcctcatttgaattttatggcctttgcttttacatttttttattaaaccttttcttaaaatcctcaatatgtcttctttccatggtataatctttcttgggaatttgcaggtgttaaattagatgcttggggctctcttaccctccctgcattcagtcagagtatggtgtatcccgtgaggcagattaatcatttttttaactgatttataagttcacactcagtttttttttctatctggaataaaatctgacgcacagagcccctctggttcaggcaaattgagccaatgttttccttgttagagaaaaaaattaaaaagcttattccaatcagcacatctcactgcaaaaagggagttcaattctttctccctgtcaaatggaatccagccatgcagaccgggctgtgatgatgtgaagatggaaagaaccttcccactcagagagtgagaggtcctcttaccctacaagacgcacattactgacctgaaggtcagagcttgaaaagtaaactatccgaggaggagatgtgacctaccaccgggtaacgcgatgcagggcagaactccacctcaaagctagaccctggacctgcccagcagttcttctaccaacatagctgggccacctgggtaaggtgtttagaattcagattctcatctcagtcctagatctactgaatcagaacctctatgagtgggatcctggaatttgtatttttcaaagccctcagggagattctgatgactagcaaggcccaggagtcatctgattaaaatagtaagactagctgcaaaacactaattttcagggaaggggaacacactaggtattccaaatagcagagaaggagacatactcccaagaaactggagattttagccaaggtggcttcctaaaggggaatttctctggaatctttttgttggtcttaaaaattgatataattttggattccattctaacggtgacatatatacaaatagatgtatatacacgcatatacagatactcttatacatattcatacatatatatctgtgtgtatatatgtgtatgtacaattgtgtgtatgtgtgtatctgttacattgcctagaacagcccacgctatagtcagaggacacatacagtctttcccaagatttctacaaatccctggtggggttgaacgtgtgagtacttatatcctgatatggtttggctgtgtccccacccaaatctcatcttgaattacagtttccataaaccccacgtgtcacgggagggacctggtgggaggtaattgaatcataggggcagtaactcccatgctgttctcatgatagtgcgttctcatgagatttgatggtttttacaaggggcttttctccctttgctcgacacttcactctcctgtcaccatgtgaagaaggatacgtttgcttccccttctgccaagattataagtttcctgaggccttcccagccatgcagaactatttgtttgttctatttctagatcctttcaccatttcatgggtatcatctctaatttttcatgcacataaagtgagcctgcatttgatttccactaaaatccattctcataaggtattgttttatacagtacactctcataaagagtattttggggagaaatgcatgggtgaggggcagtgatgtgctggatctggctaatacagggccatgagagccagccattaaatttttaggaattttgcaatccagttgttaagcaaaaccatgattaaatattatataaggttgtaattaagttgtacaattaataaaggtagtaagtattagaagctcatcacttactagctgttttactacattttattcttacctatgcccttgaagttatttgtatctactgtatttgtgtagtagaaatacaattaaatgtgttgctattgcccatctctacccaattctgtgtttagtgattatacatgggtaacctgagattggccatagcaagagtatttacatcacagaaattggcaaatgctacaaatctaggcttgatttattgctctgctgattgcctggacctaaaaattaatggataatatgttaataatgtccataagcttaaatgtgtcatgtctatagccactgcattgtcaatagtataaaaactgaagacattttttcagcatttaaaaactttttgctgattcagcaaagaagtcattcacatcattgacaaatgagtgaagttctaatatatgttttctttgtttcccttgtatcttattcattaatatataacattaaccaacattcatgttgaaactacacttgcattcaagatttgtagcctgattttatcaagtgatggttgaattgcaatcttagatcagttatacatataagaattctgcaaaaaccaagaaagtgttctgtaagtatcagctggctatatgacaaagaatactgtaaaatttattattataaactgtttgttacatattctttaggtcagtaaagtttctaagaaacttaagtatgtttccccagagacctagttgttaagcatttaccagtctcccacaagagtttatattacaccaacataaacatattgaatagtaaatgtcctttgatatatatacatgctttcacacctcattggtggtaattgttcttctcatcaggtgcaaaaactaattcccttcatcttctgcaagctgtttagtcatctctttcattggattactagataattgcaggttcccacccaaacctccatgtccttttctcccatcaagagcatgcggatctttcattggtggttacatccctcttccattcccagtcctattgtttgggtagatttaactccattctccagttacaggaattgactctgcaagcttaagccaatcagtgggttccagctctctggccacagtgattggtgcggagttgagcacatgacccaatttgggccaatgagagagaggaaatctcaaaattgtagttgaaaatattaaaagagagctatgagttttctctggacaatgtattataagataggaacaactttatccattttattatcacaggaagagagctaagagctgaagggaaagaaaccaccagaacccaagaatgaggccaaatccatagaacataaacagaatagagaacaacctaggtccatggtaaaatcacttgagctactagatgaagctttacctgaccagatcttcctggggtttaggtacaagtatgaataaatctcctttgtttttaaggcccatttgagttgggttttcaatcacttggaaccaaaaagatccttaacttttatatttgtcttgactcttaagctcaggggccttactttccattccaaggctaatcaagcctttcggtaaaagataggtaatttcttccctaagagagattctcctcaaactaataaagtaaaacatttttaaccccactagacaaaagtagtgtttctaataacttattgccaagcaaaatgaacattctagaactttgcaccatatttgttccatggcttcctacaacttgctagcacaggattacacacacatatatatatatatatactatagggatgtgcatactttagattgagaagtgtggcactgaagcatgaagccaccatttacatttcagggaaaattattttttcaatgatttgcttaaacaagaattcttggttgaatatccatgtgttttatgcggtcacagggtaggatattgagagaactggatgtagaatgcagcagtttgagggaggtgtagtgtgatgatgatgatgctaatagcaaaaactttcatagttcttgctacgtgccaggctgtgttaagtgatctccatgaattaatcctcatttccatacccagtttacaggtgatgaaatggaaatgctagcttaacttcatacaccttggttcctgagtctgtgctctaaccagtaggttgtactgcttctccactgtgtgcttaagacaaagttgggaaaatggaaatgaatttggatccattcataggaactggtgagtccaggtcaggatctgcctttggggctctgagagttgtagagtcacagtattcacaaaagatgcctaactcatgccagcaaagcagacaacagaccaaatacaattcatgcttgaagaggactggagttagaatcagagaggcagccaagagcaccatttccacagagcaagataaggctatcaacagtcaaggatcagacagcaagaagatgtggacatgtcagccaatggagcggaagggctgaagataccagctcagaatggagactaaacaatgagagggcaccaaaggatgatttttttaatgtatcaaataaagaaaagtctgatggttaaaggctatgcacttagatagaggggtactgtactagataatcattgtcatagtaatgctaggtaagaaaccatgccaagactcagtagcatccaaccacaaacattcatttcttgttcacagatttgtgggccagctggggttcagcacatctaggctatgctctgcttgaagcagcaaactgggttcagatccattctacatatctctcatcctcttcggaccagcaggaaagccagggcaggcttatataacagcattgacaaaagcaagtttatactagtgtatttcaaccaaccaaaccatatgagtttggttgaccaaaaccaactcatatggccaacctcaaagacatcggacactgtgtgccatatatgaggatatggcaaggaaggtagatttagtcctgatactatcctaggagaggaagtaattaagactaacaactaaatctactctagtgcattagtccattttgaattgctataaaggaatgtctgagactgggtaatgtatttaatttaattaatttattcatttttgagacagagtcgctctgtcacccaggctggagtgcagtggcacaatctcgtcttactgtaaactccgcctcccaggttcaagtgattctcctgcttcagtctcccaaggagctgagactgcaggtatgcaccaccatacctggctaatttttctacttttagtagagacggggtttcgctgtcatggccaggctggtctcaaactcctgacctcaagtgatctgcccaccccggcctcccaaagtgctgggattacaggcgtgagctactgcatccagcctgagcctgggtaattaataaagacaagaggtttatttgactcacaggtccacagactatacaagtatgacaccagcatctgcttctagtgaggtgacaggaagcttttactcatagtggaagggaagagggagcaggtgggtcacatagcaagggagggagcaagggagaaaggagaagcctccaggctcttaaacaaccagctcccatatgaactaacagggcaagaactcactcattactgcaaggatggcaccaacccattcatgagggatccacccccatgacccaatacctcccatgaggccccacctccaacactggaggtctcatctccacatgaaatttaggggggacacacattcaaaccatatcatacagacccaaaagaaaaacagagtttgttttacagtgatataagggtctaccctaaagaaggaagcaaggtgtgaggcagtgtccttggcattggagaaggagactggggaagtacccatcaaggtgatgaggtatatgagagaatggcagaggagaatagggggaggcggggatgcttttcccaggtcttgatggacatcactagatgggccatggctatttctaaggtagctcagtgggaagaatcactcaagattcaattgaaattgtgttcaggccagttataaactagtaaagatgcaatggtagaggttatagattgagacttaggtttcttccttttctggaaggatcctcagatcgccttactgtggatctaacatagccagcccaagagatgattaaatttgtgttctgttgggctatgtcagggtcaagttttaaaggaagcatgcagtgattcagaaggattgtgtttccttgtcaatttcacctcttgcttcttgaaggagcctttctagtcttttcttggccaccagagaatgcagccatgaacaaagttagatggcccatcatttatgtcaggaagttgtgaatgcagatttgctgagctaattcacccagattatctcagcaaatctgcatgcacaactttctcagttaaatgatctttactacctatgtcgggctgtctgaatctgaaattatacccaatattccttggggctcaggacattatagttagcttttgctggatatcagagctttacatataataaatgtcaacatctgacaccttaaaaaaaaaaaaaaccccaccagatactgttttagagcagtaactctcaaccctgtctggatgttagaatcatcttagaagctgtaatatcacagatgcctggggccctccccagactaattaaatcaggatctcaaggtagaggaagtgcctggacttttttaaatttttgttaagctctccagttgtttctaatatgtagccaggtgtaaaaaccactattttagactctctcatttaatcagcatgatgctgtattggtctggtgacttctcttataaaattcactgtgaaaatataaaatatgttcatgttcattctgtgttcgttgaagaatggaactatttgtgaagatcaacacgtttctttgctctgaaagtttgcaacagtttttagccaacagcaaggtggaggcatattttttaaatcaaaacattaataataaataattatgatgatgaccatgatgatgataaagtgtcaggacacctgggccaactgctgtcagacacaggatgttgtaactttttctcttttcccttcaggaattgtgtgcatttattgataaacatggaggcttttgttttagaatcaaggaataacggggggcagatgtgttgctagataaaatgccagcaggagaaattctttgaccatggatgggaccgcttgatgtctaccttctccttcttagagtgcacatttcttgcatgtgctacaagtgtacaaactaccttgtcttaggggatttttgagctctggatattttcagagctatttcatgggcagatgataaagtataaggtacaactggggagaagcccattctctcttctgatctgagacctctggagcagcactgatcagaaatagccgcccccatttcacagctgagactcagataaagtcagagatttgcccagcatcactcaccaaggagggatggagctgggatttaaacccagatcttccaaacaacaaattctctgctcatttcaagatagaaaaccatggtattttggggaactgggaataaaacaatagagggttctgtggttttttgtttttttttttgtttttttttttttagttaatatctccctgacattagtttctctgggcacttaggagtggctctctgtgttaagaaatctcttcatgttgtttcaaagacatccgcaagccctgtgacttcattctcaagcaacaggccactgctgtggaaaggacatgaaaccagctcatttttgcaacaaagaatggaaaaccttccctgccagaatggttcataccttttagtttttccactggggagtggaaacagtaagggaagaagcagagatgtggggcttcaactccctgtctctaccactgttgcttttccttgggaccagggacttccccgactccccacagttgccttgggaatcatccctccaggaaagaactgacactgcattcattttcctgccaggaagctcttggatggctaggagtttgcaggggatggccaggttggagaatttattttcaaagttgacctcaacttggaaatcctggccctgagctgcggggagtcgtctggtcgtccgcttgcattctgtcctgatttctttctcatgctctgagttggcttggttacagttttacttttcatttttcctccatgtctcccaaatgtagtcttggcacactctcctctattataaacctcattttgccataatcaggggttaattagataggcatcctcagattccactgcaacattctgatcagtgaacctgactggtgccaaggaagtcggtggacatgccagcagggcagaaacacaactctctgctacaaatgcatgtacagtatattatcctaaatttcttagtatgtttgtgaagcgccaagagtagtatgggagatcatattctgaaacaaaaggcaagggttgggagagaaaaaacagctttttgatgacaaagcaaattgttccacattgctgatttacccaagagattattctgcattatctattattggaatggaatgtcaaaatatttcttttcctcaaacatgttagaggttgcaaaactcatttacattgaaaatatctggccatgattcctcagctaaggaaataaccatctccaaagttatctgtggaagtcagggagccaataatgtttggctactgtgacgtttgtttggcttaatgggttccttcctgagaatctgatgtcttttccacctgctcaggctacagtggaattgaaactgacatacttctacccacaggtccctttcttctctgtagattatatgaaaaatgtgcccaattgcaattctctcattatgttcactcacctaacactgagcaaatgtctctttgaggatctgttgtctgccaagtaccccattttctctttcagcctttttcgctgctttttcatcttccagtatccctgaaagtttagagggagaccttattctgtcctgaatgtcccaggtccaccctgatatgcagcctccaggaatcagctctgggtcctattcccctcattctccccacgccacccccatcctccgccatagccccttctatgcaggcccgcattacaatgcagtgagaagaaaaatgacagtcatcgtgcaaaaaaaagaaaaaaaaaaccctaaatttaatgaacatttaactctgtctagggcctcaattgcactgcaaagacacataagtcatgtttcctgttgtctagggtggacaatctaatgaggaagatgcacccatacccagtgtgctatttcaaatcctcggcaacatgtatgtcatcacacccacaaatcagaacaaacaatggcttccagcactggagcagacccctgcagactcagtgacccaggcaacagcattctatgtgcaagataccggaaaatcttcggtgaatggctgggatgatacaggaggtgaagggggcactagagagatgggagagcaggtatttaccaatcagaatggaggtatttcaatctgtaactaagttagatgactgtgttagtgctcaccagctgagcaacagcccttctggaaccgaagcattgggagtaagcctgtctgtgcatctgatgccacctgggtcacctgataaaaaatcagattctatgtcctccattcagattcaaatttgatgattttaggctgagtctgggaataggtacattagcaaaagtcttcagtgacttcaacttggaaatgactgttaacatgccgggcaagagggtaggctttgcagtttggcaggtctgggtcagtactctggctctgacgctggcttaatctttgaggctcactttactcatctgtaagatggttgtaatgatgacgtttgtgaggattatttgagaaaatatttctgaaatgcttagcccagacctgacatagaaaagatagtaagtctgtatctccccattcctcatccaaaacaaaccaaaaggaaaactctaactgaactttctaagatgcattataggaagcaagactcctgggacccaccctatttcaaataagtcaatatttctcaaggcgagaatttacattttaaacaagcacccgacatcattcttatattcactaattaaaaataaatattgctgcagttggagaaaaaataaacagtcacctcatatcacaaaagcggggtgctgctgctctgtcaacacaggcaggttcttctaaacacagagagcatgaatgatggaggctctggaggaccaggggctctagcaccgagtctgctcgtcagtacgctccctgcatcttgcatccactcccgtgggggatgtttaacctcatttaaatacagacatgaacccccttccctcctggcacaccgtgaagaagaaatgagctaatggatatgcagtgttcatgcctaagagagcattctaattaatgacataaatcaatagtcccatgggttgggtagaaggctttcatttattttcttctttaaattttactaacattttatttatttatcactcttttcccaactataaaaatcctatgacaatggtggaacaagtgaaaaataggaaaagaacataaagtggttaaaaaatgttacttatccaggtacaatgactacatcatcaaaagggctttccaggccaggagttcgagaccatcctggccaacatggcaaaaccctgtctctactaaaaatacaaaaaatttagttgagtgtggcagtgggcacccgtaatcccagctactcaggaggctgaggctggaaaatcgcttgaacccgggaggcagaggttgcagtgagccaagatcgcaccactgcactgcagcctgggtgacaagagcaaaacttcatctcaaaaaaaaaaaaaaagaaaaagaaaaaataaaaagggctttcctgtgaaatcaaagaagatgagtatcttcttacaccatgcctagaaagaaagaaagaaacagtatagcacagtggtcaaagacatgagctctcgtctgagttctaccacgtgcaatgtgacctttagccaacttactttacattttttgcctcagttttctcagtaaggtgggtgtaatggtattccctactggataaaggactcacaataaataatacgatataataaaatgtgtaaagctctttaaactgctcaaaagacattaggctattatttcaataatacgttttgatcaagggagaaaaatagggtcagaaaacccgattgtgtataggtgttgtctattctgatgggtcagtttgtaaatatttcggctgtcatcctgggaataatagttgcagctaatattattgagcttttacagtggccagccactattctaaaagtatttagccctcaaaatagctttctgagattggggatataaagtccctatcctattctactgttttctaattttttctttcttacctgaaaagtccacctgtcaaagaaactgattccggctcaaatcacaccattgccatccagatgagcacacctagagggacattttcgtctccgctgttgtttgagggagtgatgtttgtgatgtcacttttgattgtttgctgcatgactaatcttaaatatttgtttaatatgcaaatgatacctcccaatgacagctccagggaaacggcagatgtctttccctgaaaatgacacagcctcactgctgctcgcactcagttactgacactgtgttgcttcaactcagagctttgatatacccagtttcattgcaaacgcactgacttccagcaaaaaaaggccactgttagcacatacaacacctttgtgagaattagaaaactgtgcttcctctggacagataaattagaagaaagtaccaccattaccactcccccaccgcctagtagaaaattagaaaaagctattcccatctcagtggctaacacaggaaaaactacccttctggatgtacctaatatcaaagggtacatggcttggggagtagagaaccagctaccttttgggccactacttaccttcttggccagacatccttgttcagtgcacgacctgcaaaaccatatatggcaaccctgatccagagtcctaagatttttgtgcttctgaatttctacatattgtggaataaaaatgttatttcaacagattggcatcaaagaccctcttaggaaccaagcttgataggaaaatgctttgatgggctactttatgtgcagaaagacccctcatggaagaagatggctttataggtagagtctctctctggttaacaggaatttggtaggaggcaggtggaggatggttaggctgagataagaggagaggaatgagaaacgaaaagggaactaagtaacgggaagatggcacctgtagagtgataagttcctgatggcaaggtggtcagagggctttttttttttttttttgacaaggatgtctaatattccagtttaggttttagggaggttatcacacaaatctcttctgttgccttaaagctttaccaccaatctgacaaatataaccttgactcaggccagtgcttgcaaaacagccaagtgaccccaaaactgatctaattcacaaaaggagaaacacaaatgcagagtgatccgagaagcctaattcatagaagctgctctgcaccatactgctgagagtccttgagggatgggaagagactctggctctcccaccatatatggagtaaaggtagagtcaatttcacttaaatttcaagggataaggtaaccccagcagacatcaagtttacacatgtcagcaatgatcatggagctttggctgtcatctctctacttctgtctgaattgtgatcatcatagttcatagctaccaagtgtctaataggtaccaagagctgaatatgtatgattttaaacttcaaaacaaacttagcgagatgagtatgtccacatttgagagttaatggccttggaggtaagttacatgttcaaattacagaagtgttaggtaacagagctaaaagatgaacccaaatctctccagctccagagacaaactacctttcagtgtcttgtgggagtgaattcgtatctgcttaaactgtcctttccaaccactttagaagaagagcaagttcctggggctgaatgtgggaaatacttatagctggaaacccacacatgtgagcaattttccgttaccagaataaaatcttgctaattttggagataggccaggctaaactgggtaagaatctgaattttaagatggttcttaaggcaagtataagtgtaggatatataggacagttaacagttgagtcccctgtgttggtattagttctggtatgagtttaaggaatgtgagaatcagacccagatggagaccaggaagggaaatgccttcctccagcaagaatggaggctttgttgagtcccaatttcttcttcccagccggcattcccttaactctaggagtacttagcctggtgtttggagagagtaattgctttcatttatgtgaagagcatgcagcatatgcaatgtgtgcctaattaccctgaagcatggcaacaatgatgcttatcattaaataggggctggatcaccttcgttagaagtttttcttgatgtcaacactacattccgtcatgcatgtttagacttcatggctttttaaatcatgttgtagtgtggttacaatgaagataaaagctagaggaaaacactccatgcaggaatgccaaggagcaggagaaggaaaatactgttttccatgtgccagacacactgtggcagaggcagtggcttttcatgttgacaaccgaatatctggcactgttttctttttaagttctgggacacatgtacaggatgtgcaggcttattacataggtaaacatgtgccatcgtgttttgctgcatctatcaacccatcacctagatattaagccccacatatattagctatttatcgtgatgctctccctccctgccccacggcaggccccagtgtgtgttgttcccctccctgtttccatgtgttctcattgtccagctcccatttatgagtgagaacatgcagtgtttggttttctgttcctgcgttagtttgctgaggatgatggcttccggctccatccaagtccctgcaaaggacatgatctcattcctttttatggctgcatagtattccacggtgtatatgtaccacattttctttatccagtctatcactgatgggcatttgggttgattctatgtctttgcaattgtgaatagtctgggactgttttcaaacatcccaccccctaggggatggcatcatccctcgctgataaccactagcccaaatgcaaacatcactgaggcacgagggccttcagacagagggccaaagggaaacctgggaatattctaatggcattccagagggagggcaatggagggttctgggatgtggcgccatactgatattccagagagaaagctgagagatactggacatacagtatcctagtgacattcccaagaaagaaagtactgtggggcatctggaaagcatggcaacatgaatgagacatctttctcctccaatcacaggtctaaccttgatgtcatccatgtgcaggtggaagcaaatgaggccataggttctgcttaaatccctccagagagaactggggaggagacttgtttctccaaagctaggtaaatcctgtagctgcaggattcaaacagcagctcctgggaagaactggcatcttagagatctgtgtctttctgagaaagctaaaattagtttgtaacagtgtgtaaagtcctctggaggccaagaaggagctctccctgacactgagacagggaagttcaagaggtcagaaaggcttcttctaggtgcttctgcaggggctgacccgcctaaccactgcctcactttcaacccacaggggtagagatttcacctcctatcatccatgaagctggaaacctaaaaggccaacaaattaatatactgtcactactaataacagcaaacgctgaaatagctttagccttgtgccaatcaggtatttgaaggatattagcactttttgaaattaaacttgttatttttagataagtgtagattcacatgaagttgtaagtaataatagagaaaccccatgtaccatttatccattttcccctaatggcaacgtattgcactacagcacaatagcacaaccaggaaattgacattaatatagtcaagatacagaacatttccatcacaagaatccctcatattgtgcttgtagagcctctcacacttcctaccccaatcccctccttagcccctggctgccactcatctgttccccatttcaatgacttttccatttcaaaaatggtatataaatgaaatcatatggtatgtaaccttttgagactgcattttttctctgaacacagttctctggagattgatttggattgttgcatgcgtcaatagtttgttccttttatcacttagtagtattccatgatatggatgtgccacatttctttcttttctttttctttttttttttttttttttttttttttgagacaggtcttattctgtcacccaggctggagtacagtggcagtagtgtgatctcagctcactgcaaccttcacctccctcattcaagtgattctcctgcctcagccttccggagtagctgggattacaggtgcataccaccacatccagctaatttttgtattttaagcagagatggattttcaccatgttgaccaggatggtctcgaactcctgaccttaagtgatctcccacctcagccccctgaagtgctgggattacaggcgtgagccaccgtgcccagccagctgtgtcacatttcatccattcccccactgaaggacatctgagttgtttccagcatggggatattaagaaaaaaagtgcaataaacatttgtgcacagatttttctacaaacctgctttcatttatctgggacaaatgcccgggtgtaccattgctgggttgtaaggtagtggcacgtttacttttttaggaaactgtcaaattgttttccagagtggctgtgccattttataatcccaccagcaatatatgagtgatccagtttctccacattttcaccagcactagattggagttggcatactggacagaatcaatatgttatccttgtgctaaagcaacgaggaactttccaggaaactcattagaaggttcctagatggagaagaaatgaatccatcagctcaccatattttagaatggatatatttgtcagattagcaaggcagagaaaatgcaggaagaacggatctcaagagagatgagttttgttggggatgtagtgggagaagttcagaaaagcttgtgttgttcaggacaatcacagcaacgctacccaaagtgctctgtgtctcttgatggtaaagtgaaaagaagagacagcagccaaaagcaaatttcacgaactctgaaaacccagatactcagggatcagttccctgaagtctactcaatcctactgtctgcagaattcttgcaatcaatagcacagtaaatactccagcgttagtcaaccagtggctcaatctctcaaatgcaccggacttgtccacttccatctttctcctccacccctcatttcagccttatcttttccctctctttttggcgccaatatttttatggatgcaacagaacttggtccctgtactgtagcttctattgctccatcagtcttcctcctccattcactcagaaaattctctttcctcgtggtaccaaattgttttcccatctcaacgcttaaaactttgattccaaatttctactatggcaaagagtaactgtgataaaccaaagagatggtatgaaggtatgagggatgattgggtagggctcaacagaagaaaaagcaattggagaaaaaaaaagccacaacaccttcattttgagcatattaaaatagctatttttactgagggattataaatgtgccaggcattgtgttaaatactttatcacagacaatccttcaaacattccaataagatatgtactatttttagatctcccttgaaaataggaaaagtgactttgagagatgaagttacatggctaaggtcataatactgtaagcagggaagccaagatccaaacctaggcagtcttttccagaacccttgtcctgtccaagatttatcaaccaagaaaaattcatttagtatcagctcagatattgagcctgagtctcctgtagccaggatataggttatattgtgtgagagaaaggtaaggaaggactgttccaacatgactggccatggatgtagatcttatctgggttccgggactgtatctggcttccttgagccatcttagatgcccttggatgcccagactaggtctgggcaccaacctgggtgagattcccagcctcacccagcctggtgcctgatatctaattgaaagaaagaggagccattcttatgactgcatagagggacaatatttctacaaaaacctacatattaaaagatcatttggacttccatttctaatcaaatggatgacctaccatccccctgaaaacaactaaaagtgctgatagttagaaattatcaggcctaaatctaaggaaaagcaggaactcagaaagataaacagagtgctgatccactttcgtcctgaaagtatttcccaaatctgatgagcttagacttcatgggggaacaagtgacttattaccaagcctaaagccttcccaaagtgggaagttaaatgcaagattctaccaaatatgggaccccaagggttataatatcagtgtgaggatgaaccagacataggtcccaagccccagagtctataagaaaattttgtttcacaacaagcagagcaaggaggaaaacaccttctctaaaaagacataaccacgggggttacagcccaaaatgagccacccacagggtccaacaaactctaagttgtgaacgagtttaacacatttgcagactctgccccaggtgtccagtagaggcaaaggaaaatgctctcagaagaaggtgaattccccccaatcctcaagggatgaccacatataaaaatccaaggaaaataagcagcacatagtaataaatatttaagcacacaaggacaaaaggcacaatgagcagagcataagagacatagagaaacaaccacgggagattcttggaagatgggagcaatggcaacttcgtgtttcaatctctttcaacccctacccgaaagcagagcagttatatagaaaaactaaaaacacgtggccaacatctaaacaaccaagaaccccaaattacaagagggtggggacagaccactaacagatacaagacccacacagtattgatatctgtagaacatgggaaagaaggaagttataaaagcaaaatatgatggacttggaaaaaagtgaaccccaaggtagccaactagaaagaaccaaagaaacaatgccttaaagaaacagagagtggagaggaggaaatattaagaagacaaaaagaaatgaagaacacagatatttgtacacccatgtttatagcagcatcatttgcaatagccaaaaggtagaagcaacccacatgtccatcatgtcacgcctgtaattccaacactttgggaggccaaagcaggtggatcacctgaggccaggtgctcgagaccagcctgaccaacatggcaaaaccctgtctctactaagtacaaaaaattagccgggcatggtggcgcatgcctgtaatcccagctactcgggaggctgaggcaggacaatcgcttgaacctgggaggcagaggctgcagtgagccaagatggcgccattgcactccggcctgggcggcaagagtgaaactctgtctcaaaaataaataaatgaataaataaataatttaaaaagcacagtatatatgcaatgacgtattattcagccttaaaaaaaatgaaattctgacacatgctacaacatggatgagacttgaggacatcatgttaagtgaaataagccaatcacaaaagaacaaatattgtattacttgactcacgtgaggtacttagagtagtcaaattcagagaggcagaaggtagaatagaggttgccagggcctgagaggagtaggaaatgaagtattgcttaatgggtacagagtttcacttttccaagatcaaagaagtcctggagatggatcctggtgatggatgcacattatgtatttaatactactgaattgtacacttaaaaatggtgagggtaaattttatgttttgtatactttaacatagtttttaaaaataaaataaattttaaaaagaaatgtagaggggaaaaaagagagtaacaagcattgaaaataggcaatggagatcaaacagatggatagcaggaatttgtgtacatgaaaaccaaagcaaagggacagaagaaaccctaaaaatgatatttcaagaaaacattcctaaaattaaaaagaaattatttgaagctacatttttaaagtacacaatgcaaacatgagaatgttgacctggaataattaatatttagacatatcctaatataatatgggacttaaaatattctttcagcatcttgcagaaaagaacatgtaacttttaagggaaagaaaattagatgagtatcaggcattgaaagccatactttatgccagaagaaaattgagtaatatatataagatactcaaaggaagagagcatcaaggattttatatccagcaaaaattgattttcaagtacaaaagccatagacaaacttatcacagctcaagaactcaagaaatactgtttttctaagcctttcctgagtaatctactgtagaatgagttttagacaatcaaaataacttaagggtaaataacataatgattgctaatgagcatcaaataaaaatcaattaaggtaaatagaattaagacaaaatgaaaacaaagaggggaaggaaatattatgaaaggctatatgctctggcaatgtgtatatagtatagctattaagaatgatgagactaggccgggcacggtggctcacgcctgcaatcccagcactttgggaggctgaggcgggcagatcatgaggtcaggagatcgagaccatcctggctagcacagtgaaaccccatctctactaaaaataaaaaataaattaaaaaaagaattagccgggcgtggtggcaggtgcctgtagtcccagctactcaggaggctgaggcaggagaatggcgtgaacccgggaggcagagcttgcagtgagctgagattgcgccactgcactccagcctgggcgacagagcgagactccgtctcagaaaaaaaaaaaaaaaaaaaaaaaaaaaagaatagtgagactatataggttggtcataattcgtagatctgtgtacctgaaatggataactttgctgttaccctaaattttagctcaatgaacttgaaaaaagaaggggataagaagaacatacaccaaaaaattttaagtgttttaagtaatcataatggagatgatatgattattattatattattactattcagggactgttatatacgtaaaattggataaaatgaggaattataattttatcatcctctaggtccttgaaaactaagtttcttggaatggaagagtacttattgatataatagaaatgaggtttaaaataaaacctcagaaatcttgacttagaattagaaatatcaatatgaatccatgagatattttgtatattatgttataatttgtttcttaaaaacttctagagacaacaaccaactcaacagcaatgaatatccctaagtgcccaagttatggtcttgaaataccattcatctaaaagacaccagggcttcttggagaaatagctgattccaagtgtgggatcagaaatatacaggactagcctggaatacagtataattccagataggattacagctgtcaaagaccacaagggtcacatagaaaaggcccagtagcaaactcaaacaggcttgcattggcaaagatgggagaagttgaacttcaacaaagataataaggggtagtgaattaaaattccagtatgttgaagcctatgagttcataatgcaatttgtaaaaagaacaaacaaacaacaacaaaaaaactgataccttttggggatgacaagaaaccaattcattatattgaaaactggtaaataaagaaaaataagcacatattctgcatttttcatgtgaacatactgggtaatcacatagtaaacgaaataaacggcctctgtcaaagtgcttgactgataagtgaaacacaaatcatagcatcagaacattatcgtgttaggctgaataagagccccctgaattgtccaaatattaatccctagacctatgaatgctatcttatatggcagcaaaagggtttttgcaggtgtgactaagaatcctgagatagggaggtgatcttgatgggcaagatgtaatctcagggttccttataggagggaatcagagagacgaaagacaaaacagtagtgaaagcacagagaaatctgaagatgctaaattgctgcctttgaagatgggtgaaggggctatgagccaaggaatccaattcccaactctggaaaaggtaagaaaacaaattcttccctggagactcttaagggagcgaactccttagtttcagcccaatgaacccacttgggaccttgggcctatagaactctaagaataaatttgtgtcattttaaatagctaggtttgtggcaatttgttaccacagccattgaaagaaaataagacaatcaacattttgcaaccaccaataaataaatatgttacaattttaaaagtaaaaattaaaaagaaacagaaaaaaggctgagagattaagaaatactgaaaacaggcaacagaggctgaacacagggatagcaggaatttgtgcagatgaaaaccaaagcaagggaacagaagaaatcctaaaaatgctatttcaagaaaatattccttaaattaaaaaaaaacaatttgaaactacatttttatttatttgttgttgttattatttttaagatggagtcttgctctgctgcccagacgggagtgcagtggtgtgatctcggctcactgcaacctctgcctcctgggttcaagcaattctcctctctcagcctccagagtagctgggttaacaggtgtgtaccaccatgcccggctaatttttgtatttttagtagagatgggttttcaccatgttggccaggatggcctccatctcttgaccttgtgatccatccaccttggccccgcaaagtgccgggattacaggcaagaaccaccgtgcccagctgtaatgttcactttataaaaattcattaaaccatacaattgacttgtgtgtttttctgtatctgtgtgttgccttaggactataattatgacgtttaatgaaataaaatacaggcttcagacagccttcattaaacagaagactattaaatagatgacaagaaatcaaaaatctaaagataaaacatatataaatggtttaaaaaagtcaatgagcaggtttaacttcagattagatacaaatgtagaagaataggggaactggaagacaagtcgaaagaaattatgaagcagcagctgagagacgacccaaacagaccagggaattctaacgtatttataatcagaattcaagcaggtgaaggcagaaagaatgaagaaaagcaaacctatgatgatattatgagaatttttcagaatgattacaggagagtaaacacagagtcaaggagcccaataaatatccagcaggaagaaaagcaaaacaaacaatgaaacccctcatctagacatgtcagactgaaatggcagaatactagctacaaagagaagaacataaaagaagtcagaaaaaaattaccttcaaaagatttacagttagccctacagctgacttcattagtaacaatagaataaagatcattctgaaggcttagtctctgaagatggcaagggggaaaactttaaagagggaaagacttcagattttaatttaatttctgcaggcctgtaatgcatctcattaaaattaccacaagaaggaaagaagaggaaaggagggagaaggtaggaaggaagaaaaagagataaggagaggagagaggaataaaacataaatttaagtgcagagtccttaattcctgtctggccccatatcacaatattcaaggcagtggtggcctaataaatgttttaacagatggatctctgaaacaaaaagccaagattctgtagcatttgccaatttctatggagaaagcacccatacaaagcctgatttcaagctactaccatgacatcactgagcttggatttgggaagttatatgcatagtcagctccctcaatctggtaggaggagatggttccaacaccgttgctggtttcaaggtctcacacgctgctattagtgggccagtccaaaaatcaaatctgtatctctcaaaagtcccaatcctttcctcttgatgcatctaaaaatgtgattaccaccttcttggtatgaagaagcccaggttcaatttagagcgatttcagtgtctggaccattgcgagggaagttagttgcttagtagaggctggtcttgtaggtgatgtccaaagtatactagcttaggagaagccattggtcctctagaagtcataggtactaggcaaaaatcttttcttagaaaaaaacaattatttgacagtgtgctgattaggaggattccaaatctaaataagcccagtccttcaggttaaaagtgttttgatttcctcacttaaccatttacacacaccacccaatatagtctaaccatagtgcaaaaagttatcccacaggcaagtttgtttacatgtttgcagacactgtattggttttcaagtcgaaagccaataacccctatggaacatgccctatagattacaaaagtttactaaaaactgttaagttttaataatagactacaacttgaacacttggcatattctgtaataagaaaaacacaaacttatgtacacgcatacaacttcccttatcttgtattctagaaaatgagaaagattggagtagtcatgattgggcacagtcccatttcatgcaagtttaaacttccttgggttgggactagtttcacttgggccacctcttggtctactggtatgagaaattagaaatgtagagatcctcgggcacccccagaatggcttagtttagagtctactaactgtagcattggtgaaaaacaggccacggggggatagccctatttgaagccttctcataggttgaaaccttagatgctttggaccttagcacttagctaacacacagctgcttcctgccataagctaactgccgacatacaagatgagaagtcttcctaaggtctatgtatcttagacgcccagaaccaccatttgctatgtttttatggatcagtgccaaaaagagaccattggtctagtttctctctatgcttataattactttcattatgattatcccattactctgctcttccactgactcttagttaggtaccctccagccctcttagtagaacgtcttaagtgaaataatcgggaccaagtattgtgggaatgttagcgtcttcttagaaaacccctggcctctatatgcaaagtgcccttctcccctttgcagacaaagagaagtgtgtaggtagggcctctatgtcaaatcgaagacctcattataatagtttccaaatctaggtctgctcagcttatatctgcttattaaagagcatagacagctgctctcaattgaccttcttttccccaccagaatgaagagcagctggcagcttctttagctaaagaagggaaaaatctggtttggctattccactccacagggactcagtatgaacctactgtcaaaatcagggagaagcttccactaacaagactgatggataaaactgaaaatgggcatgtaaatgtctcactagacatactgtaggacactcactctccctacagccccttgtatctcctgcacacatctcttcgacaaccttaccactgtctcagacatgtaaggtacttgccaagcagaaagaaactgttactcttcagaatcgacacttggtttagtgttgtctaggccacatccatcaatagcattctttttgttttaagttctggcatacttgtgcagaacatgcaggtttgttacatcggtatacatgtgccatggtggtttgatgcacccatcaacctgtcatcaaggttttaagccccacatgcattagttatttggcctaatgctctccctccgctatacgcccccacccccccacccacccccacaggccccggtgtgtgatgttcccctgtgtccatgtgttcttattgttcaacttctacttatgagtgagaacatgtggtgtttggtttcgtgttcctgtgttagtttgctgagaatgatggtttctagcttcatccatgttcctgtaaaggacatgaactcattcttttttatggctgcatagtattccatggtgtatatgtgccacattttctttatccagtctatcattgggttggttccaagtctttgctatcatcaatagcattcttttacatccaatcaaataatctaacttggagaaaagtactggccagaaggtaagaggagcagcattcttaatcctaagagatgtgtctacacacacacacacacacacacacacacacacacacacacaccacactctcagccagatagagtcactgcagcagtacatgccgcaaactctattttcttcttatgcttattgtttcaacttttcagaaggtcagaaatgtaaacagaacagtggctctcaaagtatggtccctgcaatggcagcattagtatcacctgggaacttgttagcaatgtaaatcctcaggcctcaccccagacctggtcaatcagaaactctggggataaagactagcattctagtttaaaacacctcccaggttgccaagtctgtcctgcataacccagcccatggatgaaatgagtactcagacacaggtatgcagtgtaagagcagctaggtgactgcctggctctagtggccagagagcagccctgagaagctggagctacttgctttcagtgcaggcacaatgccgaaaacctggagcccacaaaacctgtaggtaattaatatttattgttcccctttcagggaacatcacacaaataatcaaaagtcagttcctggtcaacataagtaaacaagcttgtttaagataaattcccccacactccgttgtacctacttcttgccctctgtctcaggattatagaacagctgcctttagctattcttcccccggggatttgcagaatcttctgacctttcagaaggtttgcatcctttccctatagtttttcctaccactctggccaatctcccatatcaggtgattctattctagtaacagtaatgtttaagaactagtggagtaaatgatgctagaaccttcagtatagccaagctagataaaaaacatttttctggaaaattgattcaacagcacccaagtagagagaaataatctataaaaaatccacacattctttctgtttgcgaccactaaatttggatcactgcctccatgttcgagtgcaagaaaagaaaagccattcacaatgagcccataaagaactgctgcaggacacagaaaagaaaatgccaccatgaacacttggaagaaaatagtggagttttctcaatgtggtttattatagaaagaaaagcaaatatataaaactatttgacaaacagtcattatgaaacaggagcaaaacatcaagagagagactaggttaagctgaaacacagaatgtgataaaaatggagtgtagttagaaaatagggaaatttaaatgtgcaataataaaattaaaaaacacatttaatgttgcaacaaccaggattgacaatgtggaaaaatgagatcacaaatgttggagacaaactgtaagaaactgacaaaatgacataaaaggcccaaacagtggctcatgcctataatccagcactttgaggggctgaggtgcacagatcgcttaggcccagaagttcaagaccagcctgggcaacatggagaagtcatgtctctactaaaaatacaaaaaattagccaggcgtggtgatgcatggcctgtagtctcagctcctagggaggctgaggtgggagaatcacctgagcctgggaagtcgaggctgcagtgaggtgtgatcaagccattgcaccctaggctgtgcgacgagaatgagaccgtgtatcaaaaaaaaaaaaaaaaaaaagaaaagaaaaagacaaaaaagatgacaaggatgagagtagatggtgaacagaaaatcttataatgtgaactattcctgagaaacatatttcaatgattattagccattgtagcagtgcatgcagagagtttgttttttatatgcctatatgttaacatgtcagagagccagaaatgctacagaaacagtaatcagagatacaacagaagatgactttccttaactgactaaagccttgaattcacagattccaaagtctcaacatgtttcaggcaacaatcattaacaatgagaacactcaaattttcacctgggtggcagaagtaagagtaggggtgggagctggggttgggattagaggggttgtcacttcagaaaactaagcctgattaacttggagatagttggggactctacgtaaaataccattcaggcaattcacattggcaatttacttcactatgacttgttccctttgtcagaagagccctgttatttaggtacaagaatttggccttaaaaacccttttcttgatcaggatttattgcctgatgttgaagttcaattaataatgggagaagatttgattgccatagagcagctgcctggatgatgggactatggatgacatttttccacctgtaatttccagattatttcctgtaatgagaatgtgttattcatttacaaaatatccatggcaaaagtactgagtatcaactatgtgcttggcactgtgctttttctttctctcttggtcttattcttccattccttccccaccccacaatcaccaacaaataattatccatgggatccaatatttacaacctcacatttaaagaaaaaagataggccgggcacagtggctcacatctctaatcccagcacttcgggagaccgaggcggacagatcatctgaggtcaggagtttgacaccagcctggccaacatggtgaaaccccgtctctactaaaaatacaaaaactagctgggcatggtggcaggtgcctgtaattccagctactcaggaggctaaggcaggagaatcgcttgaacccaggaggtggagattgcagtgagcctagattgtgccactgcactccagcctgggcaatagagtgaggctcagtctcaaaaaaagaaaaaaaaaaagaaagaagaaaagagtttttttttctatcagctctccatataaaaattccaggataagtttctgattggcctagcttgggtccaatcactgtgagagggaggaacagaaatttaagattgtccagtcctgggctgtatgttctgtaggcaagatgctataattttcaagttcattcaaagtacatgattgtattttttgatcattccacaatgcatacatgtattgacacatcacattgtaccccattatatatttatcaattaacataaaactttagaaaatgcaagctacaaaatcgaaagaaagacacatgactgtaattaggaaaaaaaaaataaggaatttgaaagggagggtatttcctttccccagaagaaccagctcatcactgttaagaagtcacaaactatagaggtcttccactacaatcccaggtccaagagacgccgggatatcttgcatcaccattcttacatatcttcctaaagtctaccatcaagacttaaacatgattccataagcaacatctgcaggactggcagctgtctgaatttgattgatactctggcaagtcaattttgaaagcatatagagctgagaatattatcttgatggtatttcccactacattccaaagttcaagagagtttgggttacctctctctacccttctgatttattgccctctaatggaccagcacaagttaaagactatcttgtaatcagcagcagctagaggcatcggcagctgcctgaatttaatactctggtagccagttttgaatgtgcatagaattgagaatattactatctcaggttccatattctccattgattttacacaatcaatgattgaaacaaggtgagtgctcggcaacctgggaggcttcaatttatcaaaggattgtcattccagacagctgctgcctttcctgatctggatgatttagaggatgacagaataatgaacgatagcttaagtgttgtgatccttcactactgcccttcaggcagcgctcaaaaacaacaacaacaacaaactccgagttctcttgcctggctgttcctgcccctgaaatagggtgactagattcagtaacagttgttttctttaataaaggatgaattaacacatgttaatgattgtgcattgttaacttaccagaccaggaggaaggagagttgactgggccacttagctgacattcatccttttcctgtttagggtgtccatgttttccttcatgtaatcacttctctctgactcttcgttcatatcctttgggtggagttgaattcatttcccattctagggatgggcatgtggctccaaccagacccatcctagcatgcactactgtggttatagtgattggttcagggatggtcacatgattcaagttgaaccaatgagatataaatacacgtcatggttaaaggatcggaggtacaggttctccacagctgtattgaatctagaattaaacttgccatcccacggagtctgagaatgaagccaacacagaggaaagtattctggcagatgaagagaaacatcattctgattacatagtttgaacaccttggtcaggcctcacctgaacctagttctggtcctcaaactttcatttataggaattaagacccattcagggttggttctctatcaactgaaacaaacaaaataaagagctctacacttaggttcaagtccaagccctgccacaaactaacagtgtgacgtggagcaagcctctttattcctctaaatttaggttttctcatctatgaaatgaagtcattagatgaggcagatatttgagctttggcattctagggtattgcactgaattattgtttcaaatatggatttttgtcagaggagacaggcagaacaacccgaatctaggccctcaggaaaaacagatggattggagcaaatgtatcaagaagtctttgcagaaagggaaaaggatatttgaagtgtttggtaggaagagttgattctccacacacttcaatatttgaagagttaattggtagcagtgtgtgtgtgtgtctgtgtgtgtgtgagacagagagaggagttatgtgttctttataacattcaatcctttgaatttcttccaactgctaagtttgattttgtaatattaaaaagatatagaataatatgaaaaaaatggctaaatgtaattatgaccctggactactaggctttattatttttggaattcctgacatgagcttgatgtattattctagccctaatgtccctgaggctagactttgagaattttttacaagagtgaaaatttcaaaatagtttagcaagtgacctaaggctaacatttcataaaacaagagtattttaatagagcaagaataaaaaatagtgggacattttatctttaagcaaagaaaattcttccttagaaaagatagttgccaatctaattcaacatttatatctttctttcaagctttctttctgacttttccctatggtctcctaagcaacatatagttaaatttccctgttaaaaatcctaatagtgtttgtcttttaatagaagaaattaagttatttatatttactgtaatcactgtgtgttagttttctttctgtcatcttaatttatggtgtctgctcttctacatctcttgagggttcccctttctagattctagctaattggtcaaatgttctttcttcctttcatttctttggtgaaatagaaatgtttcctcttttttgtattttaacttatatgtatatttttacaagcataattatgtttccaatcctgttttcttagcaatttcaaaaataaatcaatattctgaagcctactctcacccacgtactaaaaaggcagtctttcatttcttccctcctcggagattcatctcccaggtttcatcttgcagaattttggtgtatgattaatattttgttgtaggtatgcatggactttatctatttgattttatgtcatcccctttctattttattaacttatttagtaactgcattgggattttacacctgcattgtgagcaactatttgtacgctccccctattatttctttggcttttcttagttccattatgtctgtctagaagcattctaatgaaccttgggtttcctggacctatctctcatctctcaacttttccaatgtaatttttatgttattggagagaatgctttagctagatattccatatcacaaagtcactaagtcaattcattttttttcttttttttttgacacaggtcttgctttacctcctgggcttaagcagtcctccctcctcagcctcttgcatagcttggactactgatgcatgccaccacacccagctagttttttaaaaattttttgtagaaatgggggtctcactctgttgctcaggctggtgttgaactcctgggctcaagtgattcccctgcctcagcctcccagagggctgggattataggcaggcatcactgtgcccaacctcagtgcttttacttaatttttacttctgccgtcagcctttccattttaattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattttaatttttaatgttatcaattatattctaatttccaaggttttcttttttgggttatgaagttattcttatgaattactccaggtttttctgtccagtatggcagctatttaattagctacatgtggtagtcactagccatgtgtggctatttcaatttcagtttaaattagttaaagttaaatgaaattgaaattcagttccttcactgccctggccacatttcaaatgctcaatagccacatgtgggtggagactgcagtgttgggcagttcagagttgtacagcattttcatcatcacagactgacctgttgtatagtgctggtctagactgattagtattagctgctaaaatggttttccttccaacgcaaggcagtcactgtcccccaggtagtgaaaatggctgctgacagagcaggagcatcgccatcttggacaaacaccaccattttacgttccccacgctcctaaccaaaatcggccaaaagcccctctcaggtttattctccaaaataaatctgtctttaactgttaagccacttttcatgtttctttcctctttcactcttagagctgccttgagtggagaagagctacatccatgtgggcttccctgcatgatgggagggaaacttgacttctcattgtgaatgctctgtcttagttgggttcagcacaagttacttggggcagggacccatgtcctctccagctacctaaacttcagtcctaactttatgcagaaaactgacttcacagaaaacctaggagcaaggtgctgtagccagcctctctttcaaatggggaattcgtgtaattgttctgttgttctctaatttataacccttagaccatcccacagaccattgcttctcccagcctgctgtctccaatcttgatttttctccagagctctgttggaagaactcagttttacaactgtctcctctttcatctgtctggggttatggtctcctgaaggctgttaaggaatcaccattcatctgatgccatatattttgtctgtttcacacatttctcaaaacttctggcttgctgatggtgacattttccattttccagcattgccattgatttattcttgctcttatatttcctctgtcaagatgtgctcagtcagccatcttgaactgaaaggagtagccctatttcttaagcttttgtgtctacagaattagttttataaataatcatagaatgtcaggggagaaagaaaatctgagatccagtccaatccattcgttttatagatgtacaaagtgagactcatatgagaaaagtgactcacacagacctttacagcatggtaacggcaaagcttggacaaagagggcagtcacttgtctcctacactggcctctgaccattgtcccctgctccaagaaccctgagtcattataagaggtcaatgttgtccgggcacagtggctcacgcctgtaagcccggcactttgggaggctgaggcgggtaaattacgaagtccggagttcaagaccagcctgatcaacatggtaaaaccccgtctctactaaaaatacaaaaattagccaggtgtggtggcatgcgcctgtaatcccagctactcaggaggctgaggcaggagaatcgcttgaacctgggaggtggaggttgtactgagccgagagtgtatcactgtacttcagcctgggcaacagagcaagactctgtctcaaaaaaaaaaaaaaaaagtcaatgtctcagcccaggcataacctaggttcagcacagtagttgtttttttatgcagatcttttctaagctcctcctaatacaaaagaatgggggactcctattttttaaaaggcattttcaactgaactgaatgaaattaaaagaatcttccactgttggtgggagtgtaaattagttcaaccattgtggaagacagtgtggcgattcctcaaggatctagaaccagaaataccatttgacctagcaattcaattactggggtatatacccaaaggattataaatcattctactataaagatacatgcacatgtatgtttactgcagcactattcacagtagcaaagactttgaaccaacacccaaatgcccatcaatggtagactgaataaagaaaatgtggcacatatacaccacggaatactatgcagccgtaaaaaagaatgagttcatgtcctttgcatggacatggatgaagctggaaaccatcgttctcaacaaactaacacaggaacagaaaacccaacatcggatgttctcactcataagtgggaggtgaatagtgagaacacacggacacagggaggggaacatcacacaccagggcctgttggcgggggtgatgagcaaggggagggagagcattaggacaaatacctaatgcttgcagggcttaaaacctagatgatggattgataggtgcagcaaaccaccacggcacatgtatacctatgaaacaaaccttcacattttgcacatctatcccagaacttaaagtaaaataataaaagaaaaagaatcttcctcttaacctacaaattcatttactccaaaaggtccttttcccaagaacagttaaaaaaaaaatcaaggttatacttcaaaggtataagaagaaaggggcttggaaaatgcaaacagttcccgcttaggaatgaccatgatattgcagaatgggtgggagagcagtggatatgagaaataggcttcccccttccccagcaggttctggggtgggagcttattgtccatcttagtgaaatctttcatctcgagcatctgcctagttgcactcatctacaatctgtttccagtgaagcaaagtaattaattgtttcaaaatgcttttttagactttggaaaactgacctagggttaatggttcataaacctcatttatgcttctattagagattttaaaatgtgagctgatgtgcttctggactggagaggaagagaggccctcatagacctgctgtgaaacctgtagcagtggctgcagccaaggagttatcccttttttttttttttttttttgacatcttaaaggaagagagggggagcaacgcaaattctctgacatcatctctcagagggtttgatgtaacgatgacatattaaacttggagagaaggcgtacactttcccggtcctagaagtttcatcatcgaccctcagccactctacaatggggactggaaccaggctttccagtcctggcagagctcctgttactatgtattcctcgataaaacaccttcattcctgtacttggcctcatagactgtgatctttttagggataccagtaagggctctcaatatctcttctaacatgagcaaccccataacttcattcccgggtatcacaaagacttactttggggattatgaactcacatgcatccagacaccagacagatagcataaataagtcaggaagaaggatggagactggggaaccggaacaggcacatccccttcaaagggaggtcactgcttttcagttctagctggttgctggcatgcagaaatgtgtgccttatgtttccagaggagtcacaaatccagataacaagtgaagtctgacgcttatttggtgctggtgactaattaaaaaatcgagacacttccagctacaaacaacacacatctgtgatttcccccatcccaacccctggtttgagatctctggtttggttctcccagaaataactatcaaaatgcaaaggtagaaaaaaaaattacagaaggagcaggactggaaaagaaatgcaacgatgaaaggattacagaagcaacttttagataccaaatagtcagtgcctatgcaaattctaaacagatgtggttgacctggtgaagttccagcctccagaacactcccctcctggccaccaatagtggtctttgtaacatgcaaactctttgtttatttgaattctgggccaggctaaagtggcagtcgcctcaataaagggggagccttcaggaaggtgggtattcctaggatattctcaaggatagacaccctaagatattcaaaaagattgaatttccaaggtatacgcatacaaatcaattgaaatgtaaccatagcaattataataaatcacttcagttcaccaagtgcctatgtactaatgtcagggtaagtgacttatagaagtcgtcttgtttcgtttgcacaacaaacctaatatgtactataattatcccttttcctttttatttattttttattttattttatttatttttttgagacggagtctcactctgtcgcccaggctggagtgcagtggcgccatctcggctcactgcaagctccgcctcccgggttcacaacattctcttgcctcagtctcccgagtagctgggactacaggcacccgccaccacacctggctaatttttgtatttttagtagagacggggtttcactgtgttagccaggatggtctcgatctcctgaccttgtgatccacctgccttggcctcccaaagtgctgggattacgggtgtgagccaccatgcctggccataattaacccttttgtatagatgggaaaacacactcagggaggggaattcgttttcctgcagatcacaggtgataacacctgaattttgttagaaaatgagctccctcaatctatgtgttattctttgtctcccttgaggacacagagtaggaagttcaacataatgttgaagtggttttcccctcccaacttccaaagattcccagagtgggcttaaaagtaagagaacagatggtggttgggtggtggcggtggtatatcaatttcctccaaatgtatatctggaatatacaaaaacaaactagggtgagcagaaaaatcgcatgttctaaaaatgaaaagactgtagctttcaagatatttatcattttgtgtactctgggaccatatggataatatcaattggcctaagattggaaggataaggaagggagaccacaaaaggctttgagaaagcaaggggtagacactgagagggagagcatgacctggacagtgaattgctcatgtgggttgttgagatgtttatttattttatatttatttttttgagtgtcgttctgtcacccaggctggagtgcagtggtgagattttggctcactgcaacctctgcctcctgggttcaaccgattctcctgtctcagcctcctgagtagctggaattacaggcacatcccacaatcccagctaattttttgtatttttggtagagatggagtttcaccacgttggccaggctgatcttgaactcctgacctcaagtgatccacctgcctcggcctcccaaactgctgggattacaggcgtgagccaccacacctggcctgttgagatgtttaaaaacaactttattgagatatacttcacataccacacaaattgcacatttaaagtatacaattcaatattttcagtatttttgcagacatgtgcaaccatccccacagtcaattttagaacatttttaccacctgtaagaagccctgtgccctctagccttcatctccctgttccccatcccttccctgaaatctccagaaaaagctctagagttggctactcctgggatttccaggagtataagccagaagtcctctgccagttcgtttttcagtttaaacatcaccaatcaaacactgatgtccttgccctctttttcttttcttacccctacctttctgataacttagcattcccagtcctgacttaggagaagggttggatttataaacaattatcccaggcattgttcaagaggtctctatgtttagagtgggtctaaatgcagaaactagtacccagacctttctccaagcaccgtcaaaggcagtacttctgaatgcatcttcacaaccttttgttctattttctgcattatcttgaagaggctacatcattgtgaaaatgtaggaaataagtgatttttgttcaaagcaatgatgggaagtggtcattcttaaatgatgtctattaacgacctacaagtgaattgaaggtgctaggcattgcgagttgtgcaaagagattttaaactattttggggaagatagaatatgaattgtaactggaaggaacatgacatgggaacagagcattttcttaagaatcaaactaattgggttcaaatcctaatcccactacttaccaactgcacaacattgggcaagttagctaagcttctctgagtctcagtccccttaccaataaaatagaaataatgtcactgtattagtccattttcatgctgctgataaacacataccagagactgggaagaaaaagaggttttaatggacttacagttccacatggctggggagacctcacaatcatggcggaaggcaacgaggagcaagccgtatcttacgtggatggtggcaggcaaagagagaatgtactagcaggggaaatgccagacgcttataaaatcatcagatctcatgataactcactcactatcaggagaaaggtatggggaaactgcacccataattcatttatctccacctggccctgcccttgacatgtggggattattacaattcaaggtgagatttgggtagggacacagagcccaaccatatcagtcacctattctatatggtgtttcaagattaaaatatgtgggattgacaagcaccacaacaattattatttctactactactaccaccactaccaccaccatttaagtgagcatttatttgtcaagaagttataagtcacttaatatgtattatctctctaacccatccaacaacttggaaaagcatacaagatataatcctcccttcacagatgtaaaaaactggctcagataagtgaaataacttgccacaaaccatacagctggtgagtgtcggaactaagtattaaaaccagacttgttggtcacaaagatgacatcacacccattattgtcataattaattactactggaacagtgcaaggaggaatccagaacatgaaagagacatttttctttcaaaagctagaaatccatcttttaaaagtcaggcaaacactgtaaaatttaaaataggtaatttcacattttgatggctgtgttagaaactaggcaatatcaagtacagggcttaaatgccagtgtaaggatgagagactatgtctagacagctggtataccagctccaacacatcgtctgtgttcacccatccaccccacaggccgaaatgaatttttaggaagagatgctattcagtccctctgtaaaggggcttccagaacataacctgccattcctggaacaatgttgtaacatcccgggcagagaaactctgtcctctgctcagcaacaaaccttgggatttgcccagtttcttgtccttgggttcttgcaaagtcaccataatttgaatttttataaatcaaatcctatttcaaatgcaattgaagaacttgcactttaaaagaatcctgtcttgaatcctcaagaaaatggaagactgccgttgaaactgaatagctattcctaaaattatccattttgcaaatttggaatttggttcccaaccttgtgaaaacaacctgtaaacttcgaaaccaatttgaaattcaagtttgtggctgggtcttttgggcactccttatcaccttggctgataagcatttaaatatattcattaacaaaaatcattgttgtcacagttaactacattagcaccttttaattgaattagaaattagatgggggtcatgaatatttcactaggattcactgccagccttcccaatttccatcttaaaaaaaaatactgtcacgtagcgtaaacggatgaattcacaatgttcttgttcccgccttttcttatagttttgccacaaaagtcatcccggtgtcgaaaatgaatcagaaacaaatttttaactttcatgctgctcttctgtgcatcttggcatgatgcaaagagttttctgtccttaggaaactttatataaacatttactcaacacaatccagaaaccatcagtcccattgcatgctgagaaggctggggtttttgaggtagagccagattctcaatatcagcacaactgacttttggggctaggaaactcagtgggaggcctgtcctgtgcgttccagggtgcttagcagcatccccggcctctatccactgaatgctagtagtgcacatgacacgctccatcccctgtgtgacaactaaaatagtctccagataatatttgtttgtctctttgtttgttcgagatggagtcttgctctgtcacccaggctggagtacagtggtgcgatttcagctccctacagcctccaccttctgggttcaagcaattctcctgccttagcctcccaagtggctgggattacaggcacacaccactacgcctggctaatttttgtatttttcagtagagaaaatgtttcaccacgttggcctgactagtctcaatctcctgacctcaagttatctttgcctaggcctcccaaagtactcagattacagacatgagtcaccgtgcctggtcatgtctccagatatttggatgtccaaatcatatcccacccttgggggagaagtttgctccccagcttggaaccactaagaataatatagattcaattactagccctgcctcttgtgtttggcccttctctgggcctcagttttgttttgtatatgtgaaatagaagcgatcatcactacctcactaggttgctaagagatttaaataatatcaagtgaataaaaggcatagctgagggcgtgttcattaattaatatgtatgtagtaataatcatagtaacagaagcagcagcaacactagcagaacttgcatcatgacgtgagggaggtgaaggaaaggactagctgctcctcttctgtttatactacactccactcatggaagtgcccatgttactgggctgaaccacatgaaccttccctgccggaagaaagacccaagagggcaccttcaaaggcagcagtagcccctcgtccgcgaatctttaagctggtttgactcaccctccatgccacatgtgcggtggatggtcaaagcaagccccagatacgtctccagtggagacatctgagacagcatggtgaggtttaaaaaaggaaattggatttggagtctaagggacctaaattccaaacttggctgctgattctgggaagtgttgggcaagttccttaatttctgtgagcctcagtttccttagctttaaaatagagtcagtgaaaattctcccacagactggttgtaagaactaaatgtggtaacgcatgcagaaagcccagtgtgatgcttgacacacggtaagtgctcaattatctgtagtaattatcatttttatgatgaagaatatcatgatcctggcccagcatggtggctcacacctgtaatcgcagcactttgggagcctgaggcaggtggcgggtggatctctctttttttttttttttttttttgagacagagtcttactttgtcgcccaggttggagggccgtggcacaacctcggctcactgcaagctctgcctcctgggttcacaccattctcctgcctcagcctccagagtagctgggactacaggtgcccgccaccacacctggctaatttttttgtatttttagtagagacagggtttcactgtgttagtggcaggtgaatctcttgaggccaggagttcaagaccagcttggccaacctggcaaaaacccatctctactaaaaatacaaaatattagccaggcatgatggcgtgtgcctgtaatcccagctactcaggggactgaggcaggagaatggcttgaacccgggaggcagaggttgcagtgagccaagattgcaccactgaactccagcctgggtgacggactgagactctctcccccacaaaaaaaagaatatcatgatggtttacagcaaggtttctccaccttggtgctatacacattgtgagctgaataattctctgttgcgggaagctgctctatgcactgtaggatgtcagcagcatcactggctaatgagatgccagtagcacttgtccacagctgtgacaaccaaaagtgtctccagacatttccaaatgtcccacggagacaaaactgccccccttgaggaatactgctctacaggaagtggattcccttcctagtctaattggtcactgtatcctgggtggatgccacctcttctgggaagaccccctgccttccttatgcagaattcaccgctcccttcattgcctcgtaagtgtttgtttgcttatctgtgtggtctgctagactgggagccccacaagggccagcttcattcagatctgtgtctggagttggcacagagtggaaggtagtgaacagagcaggaaaggttaaacaaaaaagtggttaaaaaatcaaaagaggacgggcgcagtggctcacacttgtaatctcagccctttaggaggccgaggcaggcagatcacttgaagtcaggagttcaagaccagcctggctaacatggtgaaaccctgtctctactaaaaatacaaaaattagccaggcgtggtggcctgttgtcccagcaactcagggggctgagataggagaatcacttgaacctaggaggcagaggttgcagtgagatgagatcacaccgccgcactccagcctgggcaacagagcaagaccccacctgtctcaaagaaaaaataacaataataataataatcaaaactaaaaaataatagatgttggcatggatgtggtgaaaagggaactcttttacattgttggtgggaatgtaaactagcatagctactatggaaaacagtatggagattccttaaagagctaaaagtagatctaccattcagtctagcaatcccactactgggtatatacccaaagacaaagaagtcgtatgaaaaagacacacgcacacacatgtctacagaagcacaattctcaattgcaaaaattatggaaccaactcagatgcccatcaaccaaccagtggataaagaaaatttggtacccatacaccatggaatactactcagccataaaaggcaatgaaataatggcctttgcagcaacttggatggacttggaagccattattctaagtgaagtaactcaggaatggaaaaccaagtatcatatgttctcactgataagtgggagctaagctatgaggatgcaaaggcggcatacgagtaatataatggacttttggaattcagagagaagggtgaaggtgatgaggcatcaaaaactacatattgagtacagtgtaccctgctagggtgataggtacatcaaaatctcagaaatcaccactaaagaacataaccatgtaacaaaaaaccacctgttccccaaaaagtattgaaataaaatttaaaaaaattaaaaaataaactgttattttctgagcacctactgtataccaaagacaaagcctaaactgcttgcaggcatgatttccttcaatcttctcaatgggttggtcaagtatttatttttgtgcccattttactgatgaagaactgaggcttagaagaaactcagttagagacacatggcaagtatttgaatgggcttagggtttgaacccacattctccccagtttgtgctgcaccctagaggtctcccatctgccaagggctttatcaaatgcattccttgtcccatggatgagatcaggccaggcgcggtggctcacacctgtaatctcaacactgtggaaggccgaggcaggtggatcacctgaagtcaggagttcgagaccagcctggccaccatggtaaaaccctgtctctactaaaaatacaaaaattagtcaaatgtggtggcaagcgcctgtagccccagctactcagtaggttgaggctggagaaccgcttgaacccgagaggcggaggttgcagcgagctgagattgagccactgcacctcagcctggacgagagagcgagactccgtctcaaaaaataaatacataaataaataactagagagatcagaaaattggggtggattgcccaaggtcaggaaatgagctgacctgcttgaagaaacaatccattctggatccaaagaggaggcactgggcatttttttacttttactgaaaaggtcgtattggaggcagccccagtgacaccttttgacaatttcagaaagttccacctgcagtttggaggcaaagctgaagccaaggcctacatcgtcccagcccctctctccacctccagctcaaacaccagctggcccttagctcttggaacattagtctgcagggggaacagatcctggtgcatgaaggaggcatctcccatcctagacttgaccactccccagtgcagctgcttctcgttgtttcagagattctgagaaatatgttaaataggctaagggagacatacaaagtggacagcagactccaaaaggttaatatcttccttttcagatggttcccacagttgccatggatatctcctacaggaggctttgcaagttccacatgaaggggctgaaattaataaactcctttgaactcagaggaaacaaaccaggtggggctaaaaatgctgcagcctgtttgtatccatcttggacaggggggcctagaagagcaggtgtgtgtgcaaagggcgtttgggtgtttatctgtgggtatgtgtgcgtttcaaccacacatatgcgactgtatgtgtgcctttggtttgtctgtgtatacacatgaaagagggtcagaaaaggactagactgtctgcatatcccaaagggcaaagatttatttgatgatagtttccccaactaggcggcaatatattcaaggtcaagggctgttttttatttgtctctgcaatcccattagcacctagcctggtgccttgtggatgttcagcaactgtctattgaacagtttcatctgttcatttaacaaataattttgagggcctggcactgtgctacgcacagaggttattaccacagtgactaagacagagattctttcttcatggagcttaggagcatgagacaggtggacgaatgggctgaaggatgaattctcaaatgaaaagtcatataagtacctttcctgtggttcatgtgtgtaaacgtgtgcacgtgtgtatgtatgtgcacacaggtatttataaagagacaaaagaattacttgaaaaatgaagtgccagtgaggaacagagtccatgtataaaaaataaagaacgtgggccgggtgcattggctcatgcctataatcccagcactttgggaggctgaggtgggtggatcatctgaggtcaggagttcgaaaccagcctggccaacatggtgaaacctcgcctctactaaaaatacaaaaattaaccaggcacggtggcaggcacctgcaatcccagctactcgggaggctgaagtgaaagaatcacttgaacctgggagacagaggttgcagtgagcagagatcgcaccactgcactccagcctgggcgacagagcaagactgtgcctcaaaacaaaacaaaacgaaacaaaaaatgaagaacatggacaccggcgtcaacacgtcctgcctctgttgctaatcagctatacctccttagtcaatcagagccacagtttactcacattgaatatttttggcacacctaccatgtgtgaggtacgttccccgccctgggacatagcaaggagtagagcagacatcaatccccaccgtcattgagtaatgattctaaaactcagtgagtgccagaatggcaagaggctccaaggtggcccagggaagcagggaaggtgtctgaaggaagtgactcttccaccgagacatgaaggatgtataagaatcggttaagtgacaggtagaggggaaagagtcccaggcagaaaaaatagtgtgcacagaggtcttgaggcaagagcaattatggcacgtttgaaaagctggaggatattgaatacagcagcagcactgtgtgtaaaggggaggaaaggctgtatgaatgggtgtacatatgtgtccatgcatgtgtgtgtgtgtgactcagtatgagtgtgtctctgtatgtgtttccaggcatgtgattatgagtgtgtatctgaataagtgtgtgcatgtgtgtctcggtatgtatgtacatgtgtggtatgtgtgtctgagtgtgtctgtgtttttaagcatagtgcgagtgtgtgtgtctccatgtatgtgagtctgtgtgtgcatgtgttcccatgcaagtgtgtgcaagactgaatggctgtctgtgtgcatgtgtgtctaagcatgtgtttatgcatgtgtctgaatgagtgtgtgagtttgtgtgtgtgtgtgtgtccaggcatatgagtgtgggtgagtacacatccttacaaagaagtttgcagatactacgaccagaaagccacagataaaggaataagacttcctatgggagttctgtaaccacagagcaaaatcaatattctaaccgaattgcttttatagataatgtattatgtgagaaaagttttaattaaagtgtggcctctaagaaggttgctccaagactcacagatttcactgttctgctcagacagagctcagggcaggtggggagcaagctgggtattatccaacaggcagccctcccattccttgtcctcctctgtggctgccattttcacctgccttgttataaattcattaaaaaaaaaaaaaaacggccatgcacgatggctcatgcctgtaatcctagcactttgggaggtcgaggggggtggatcacttgaggtcaggagttcaagaccagcctggccaacatggtgaaacctcgtctctactaaaaatacaaaaattaactgagtgtggtggcgggtgcctgtaatcccagctactcaggaggctgaggcaggagaactgcttgaacctgggaggtggaggttgcagtgagccaagatcacaccattgcactccagcctgggcgacagatacagactctgtataaaaaaaaaaaaaaaaaaaaaaaaaaagcatatttaggaaatgctgttcattaatgttccagaaaactatgctaacatattgatagtcaaagaaatgcagacgaaaacaaatcatattctttgcataaaagagaaaaaaatagaatttaaaataataatatttgcttgcagtaagggtacagtataccaggtacgtttgtgataggagtgtagatcggttcatattttctgaaggatatttgaaccatagtatctgaaactttaaactagacatacctttggattcagcatttctgcttctaggaatttagccaaagaaaataatcactcaaatggggcagattaagtgtaaaaagttgctcatcaaagcatcatgaagatgcaactcttgttatgatggtgtgatctttcccataattggcctctaaaggctgagaacaaaaggtcataaacattccacattttaagtatagtaaccaccaatatttggccagctttctccctgaaagtttaggtttcaggtagtggtgtgctggtaaatgtttaacaaacagctatggagtggaggtggagatggggggttgtcagatgatacaaatttccatggtgtaaatactcccaccagggctgattctgcgcttccaatgcgtgcttgctgaatgcagagttttgaagagatactaacaattggccctcacgagccaatatgagcaccttcagcatacgatgggatagaggagccacttctgctgaagcaatgctgattccttgcaatgcatgctccacagcacatataagtcagggagggagagtgaagttatcctttggagaggcgcagcgttggtgcagagagattctccctacttccgcttacttccccagaggttctactcctcgttgcaaaatgagggatgcacaaagcaaatagctcactaagttgggaggcatttataagaaggggctgccagactctctctctctgcttgctgaccagtttagtgcttcctgagctaattaagaaggcattgggacacaataatggtgcagactgaccacaaggctgataggagacaaggaccactttctttcaagtcccagctttgcaagtggaatggaagatggatgaggggaaagggcactctaaatagcgtgtgaaattgacattgtccaatgatcaagactgaatcttcagaaccaagctcaaacagagacttttaatactaggatgtatctgtctgaaccacactagtgatttccttgaggaagcctgctaggtaacaggataggaaaaatttgaaagggcagagttaacagcagctattggaaaagaatacatttttctggttttacctcaatgacttgaggcttgtcaatcaaattggtcacacttttgaaataacctaagtatccatcaagcaggaattcagtataatacagcacatccatttattcaaacagcatgcagatattcaaagatgttaatacccattgtgtgtgtgtgtgtgtgtgtgtgtgtgtgtgtgtgtgttatctgtatcttaattcaagtaccaccaaataatcactgatatatgcttctttgaggtttttaaaacttaaattttatagtctcatttttaactagacagttaataactctgtgaattaaaaacatctcttttccttgggtctactctgatatagtcaacactggagaattcaaaatcacagtatagtctttctaccatagttgctaccaagaaaagatgactgcaataaatgaaaagatgaccacaataaataggtgagtgggaataaaaagtgatttacaaataattatgtacaatatgaccttgcttttgtaaaagaataaaaaagtgtataaccatatatataggaaaacatctggaaatgtacacactaaaatgtcaagagtagttgctctgggtggggtatggtatatagacctttatttaatcatttgctcaacttgccattctttggttaatacttattaagttctcactgtgtatcagagacactgctagccacccatacttccctgttttatctagtattttacagatcttttgccttataattaacatgcatcaaaaaaatcaggacaggaaaagagagagcttttattttgctgaaaaaacgaagtactcagcccacagtacttagaactcaaagggtacttagtaatggtggccatgattgtatcattctgtgaatcttggctcttcctctgctatagcttctagaacaatcgttgtaacaacaacagtgataggcggttccaagatggctgaataggaacagctccagtctacagctcccatcacgagcgacgcagaagatgggtgatttctgcatttccaactgaggtactgggttcatctcacaggagagtgtcggacagtgggtgcaggacagcgggtgcagcgcaccgagcgtgagcagaagcagggtgaggcatcgcctcacgtgggaagtgcaaggggtcagggaattccctttcctagccaagcaaagctgtgacagatggcacctggaaaattgggtcactcgcaccataatactgtgcttttccaatggtcttagcaaacggcacaccaggagattatagcccgtgcctggctcggagggtcctaagcccacggagccctgctcactgctagcacagcagtctgagatcgaactgcaaggcagcagtgaggctggggtaggggcacccaccattgctgaggcttgagtaggtaaacaaagcagccaggaagctcaaactgggtggagcccaccgcagctcaaggaagcctgcctgcctctgtagactcctctgggggcagggcatagccaaacaaaaggcagcagaaacctctgcagacttaaatgtccctgtctgacagctttgaagagagtagtggttctcccagcacggagtttgagatctgagaacggacagactgcctcctcaagtgggtccctgacccccgagtagcctaactgggaggcaccccccagtaggggcagactgacacctcacacggccgggtacccctctgagacgaaacttccagaggaacgatcaggcagcaacatttgctgttcagcaatattcgctgttctgcagcctccgctgctgatacccatgcaaacagggtgtggagtggacttccagcaaactccaacagacctgcagctgagggtcctgactgttagaaggaaaactaacaaacagaaaggacatccacaccaaaaccccatctgtacgtcaccatcatcaaagaccaaaggtagataaaaccgcaaagatggggaaaaaacagagcagaaaagctgaaaattctaaaaatcagagcgcctctcctcctccaaaggaatgcagctcctcaccagcaacggaacaaagctggtgttttgttttgcatgactttgatgagctgagagaagaaggcttcagatgatcaaacttctcccagctaaggaggaagtttgaacccatggcaaagaagttaaaaaccttgaaaaaagattagacaaatcgctaactagaataaccaatgcagagaagtccttaaaggacctgatggagctgaaaactatggcatgagaactacgtgacaaatgcacaagcttcagtagccaattcaatcaactggaagaaagggtatcagtgatggaagatcaaatgaatgaaatgaagtgagaagagaagtttagagaaaaaagaatgaaaagaaacgaacgaagcctccaagaaatatgggactatgtgaaaagaccaaatctacgtctgattggtgtacctgaaagtgacggggagaatggaaccaagttggaaaacactctgcaggatatcatccaggagaacttccccaacctaacaaggcaggccaacatttaaattcaggaaatacagggaacgccacaaagatactccttgagaagagcaactccaagacacataattgtcagattcaccaaagttgaaatgaaggaaaaaatgttaagggcagccagagagaaaggtcaggttacccacaaagggaagcccatcacactaacagctgatctctcggcagaaactctacaagccagaagagagtgggggccaatattcaacattcttaaagaaaagaattttcaacccagaatttcatatccagccaaactaagcttcataagtgaaggagaagtaaaatactttacagacaagcaactgctgagagattttgtcaccacctggcctgccctaaaagagctcctgaaggaagcactaaacatggaaaggaataaccagtaccagccatggcaaaaacatgcccaaattgtaaagaccatcgaggctaggaagaaactgcatcaactaacgagcaaaataaccagctaacatcataacgacaggatcaaattcacacataacaatattaaccttaaatgtaaatgggctaaatcctccaattaaaagactcagactggcaaattggataaagagtcaagacccatcagtgtgctgtattcagaaacccatctcacatgcagagacacacataggctcaaaataaagggatggaggaagatctaccaagcaaatggaaaacaaaaaaaggcaggggttgcaatcctagtctctggtaaaatggactttaaaccaacaaagatcaaaggagacaaagaaggccattacataatggtaaagggatcaattcaacaagaagagctaactatcctaaatatatatgcatccaatacaggagcacccagattcataaagcaagtccttagagacctacaaagagacttagactcccacacaataataatgggagactttaacaccccactgtcaacattagacagatcaatgagacagaaaattaacaaggatatccaggaattgaactcagctctgcaccaagtggacctaatagacatctacagaactctccaccccaaatcaacagaatataccttcttctcagcaccacatcacacttattccaaaattgaccacatagttggaagtaaagcactcctcagcaaatgtaaaacaccaaaaattataacaaactgtctctcagaccacagtgcaatcaaactagaactcaggattaagaaactcactcaaaaccgctcaactacatggaaactgaacaacctgctcctgaacgactgctgggtacataacaaaatgaagtcagaaataaagatgttctttgaaaccaacgagaacaaagacacaacataccagaatctctgggacacattcaaagcagtgtgtagagggaaatttatagcacttaatgcccacaggagaaagcaggaaagatctaaaattgacaccctaacatcacaattaaaagaactagagaagcaagagcaaacgcattcaaaagctagcagaaggcaagaaattactaagatcagaacagaactgaaggagacagagacacaaaaaacccttcaaaaaatcaatgaatccaggagctggttttttgaaaagatcaacaaaattggtagaccactagcaagactaataaagaaaagagagaagaatcaaatagatgcaataaaaaatgataaaggggatatcaccagcgatcccacagaaatacaaactaccatcagagaatactataaacacctctatgcaaataaactagaaaatctaaaagacatgaataaattccttgacacatacaccctcccaagactaaaccaggaagaagttgaatctctgaatagaccaataacaggctctgaaattgaggcaataattaatagcctaccaaccaaaaaaagtccaggaccagacggattcacagccgaattctaccagaggtacaaggaggagctggtaccattccttctgaaactattccaatcaatagaaaaggagagattcctccctaactcattttatgggaccagcatcatcctgataccaaagcctggcaaagacacaacaaaaaaagagaattttagaccaatatccctgatgaacatcgatgcaaaaatcctcaataaaatactggcaaactgaatccagcagcacatcaaaaagcttatccaccatgatcaagtgggtttcatccctgggatgcaaagctggttcaacatacaaaaatcaataaacgtaatccagcatgtaaacagaaccaaagacaaaaaccacacgattatctcaatagatgcaggaaaggcctttaacaaaattcaacagcccttcatgctaaaaactctcaataaattaggcattgatgggacgtatctcaaaataataagagctatttatgaaaaacccacagccaatatcatactgaatgggcaaaacctggaagtattccctttgaaaactggcacaagacagggacgccctctctcaccactcctattcaacatagtgttggaagttctggccagggcaatcaggcaggagaaagaaataaagggtattcaattaggaaaagaggaagtcaaattgtccctgtttgcagatgacatgattgtatatctagaaaaccccatcgtctcagcccaaaatctctttaagctgataagcaacttcagcaaagtctcaggatacaaaatcaatgtgcaaaaatcacaagcattcttatacaccaataacagacaaacagagagccaaatcatgagtgaactcccattcacagtggcttcaaagagaataaaatacctaggaatccaacttacaagggacgtgaaggacctcttcaaggagaactacaaaccactgctcaacaaaataaaagaggatacaaacaaatggaagaaattccatgctcatggataggaagaatcaataatgtgaaaatggccatactgcccaaggtaatttatagattcagtgccatccccatcaagctaccaatgactttcttcacagaattggaaaaaactactttaaagttcatatggaaccaaaaaagagcctgcattgccaagtcaatcctaagccaaaagaacaaagctggaggcatcacactactgacttcaaattatactacaaggctacagtaaccaaaacagcatggtactggtaccaaaacagaaatatagacaaatggaacagaatggagccctcagaaacaataccacacatctacaaccatctgctctttgacaaacctgacaaaaacaagaaatggggaaaggattccctatttaataaatggtcctgggaaaactggctagccatatgtagaaagctgaaactggatcccttccttacaccttatacaaaaattaatttgagatggattaaagacttaaatgttagacctaaaaccataaaaaccctagaagaaaacctaggcattaccattcaggacacaggcatgggcaaggacttcatgtctaaaacaccaaaagcaatggcaacaaaaggcaaaattgacaaatgggatctaattaaactgaagagcttctgcacagcaaaagaaactaccatcagagtgaacaggcaacctacagaatgggagaaaatttttgcaatctactcatctgacaaagggctaatatccagaatctacaacgaactcaaacacatttacaagacaaaaacaaacaaccccatcaaaaagtgggtgaaggacatgaacagacacttctcaaaagaagacatttatgtgccaacagacacatgaaaaaatgctcatcttcactggccatcagagaaatgcaaatcaaaaccacaatgagataccatctcacaccagttagaatggcaatcagtaaaatgtcaggaaacaacaggtgctggagaggatgtggagaaataggaacacttttacacagttggtgggactgtaaactagttcaaccattgtggaagacagtgtggcgattcctcagggatctagaactagaaataccttttgacccagccatcccattactgggtatatacccaaaggattacaaatcatgctgctataaagacacatgcacacatatgtttgttgtggcactattcacgatagcaaagacttggaaccaacccaaatgtctgtcaatgatagactggattaagaaaatgtgacacatatatacacaccatggaatactatgcagccataaaaaaggatgagttcatgtccttagtagggacatggatgaagctggaaaccatcattctcagcaaactatcgcaaggacaaaaaccaaacaccgcatgttgtctctcacaggtgggaattgaacaatgagaacacttggacacaggaaggggagcatcacacactggggcctgtcgtggggtggggggatgggggagggatagcattaggagatacaccgaatgtaaatgacgagttaatgggtgcagcacaccaacatggcacatgtatacatatgtaacaaacctgcatgttgtgcacatgtaccctagaacttaaagtataataaaaaatatttaagaaaaaaacaacagtgatgatagcctgtattgatatagtatttgttacatgccagggcggggttctgaatactgatttggctcaaaataactctatgaggtaactatcattcccattttacacatcaggaaactggaggcagaaatattgttcctgcaataacaggtctcctccctccataagtgcaacctggcctgagacttggggcactgtcttcaccccaccccatccctgaaactgctctgataggaacaatagacctatacacacaggcacacacccagaaatagattgggatggttctggcctgggttattgtgggtgactcagacggtcagagaaaaaggtaatgtaacgcagacaaatgtgagataataagtctgaagccaatgaaacaaaggagagggagagcacatactaaataaaaagtcatgagtccctgcagcctggaaagggatttagagtttactgttaaaaaaaaacaaaaaaaaacaaaaaaaacaaaaaaaaaacaacaacaacaaaaagaaaaccctccttgaaattgtcagcactttgtactatcagagtacacttgggaatcgaggggctcctgtgtccatgcctgtggcatctttatccactgatggaggccaggaaggagggggtctggtcattccatcctgctggggtcaggctgggagcaggagagctgtttctgagcctcggtgtgtccacggtggatccatgcttattctgggtcccaaggaagaggctgggctgaaacaacaggaatgtgtccctgtagacagcccagcaagaagtggtgtagggtggggcagaagatgagttccaggatctcagagtaaggatttgcatggaggctggaaaatctggaagaaaggcaaagtacacgcggattgcagatggtcggggtgaatgggaaggcttcagccaaacaggatagatggcagccagaaaggaagtgtactgggggcttgaatggtctagaaaagcctgctagaagatggggcaaaaaaggtcagataatgcaaatatccagggacaaagccctctgggggaggaggagaggttttgagcatggagtgatggggatggtttaaaccaggccaggagcctttttttttttttatttctaattttaatttttagagtcagggtctcactttttttgcccaggctggagtgcagtggtaagatcatggctcactgcatccttgctctccttaagcaatcctcccacctcagcctcctgagtagccaagaccacaggtgtgagccacagcacccagctaaattttttatttttagtagagatagggtctcattatgctgcccaggctgggcttgaactcccaggctcaggcgatcctcctgccttggcctcccaaagtgctgggattatggacatgagccactgcatttggctcctgggggcatttttgtatccaaagaacacaaacagatgatattaacaaaagcaaaaccaactaattcagtcttcatacttataaggtcaatattattatccctgatttaaagaggaagaaactgaagcacagagggtttgggtaacttaacctcaggtcacccaaccagctagtgacagagctagaattcaaaccgaggtcacctggctgcattgcatgtgctcttgacaaagattctcaacttgatctgactgtagtcaggcttctcagagacctctgtccgaacaggtcctgaccttggtctttgtccttattccaggcccacttttagcaagaatcctgttgagtcagtttattgaaaatctcccaccctcagtatcttatcaccctggtccaccttcaaaagaaaccctgttaggtcagcttagtaaagaattaccctatttcttagtgagcttccacccaccaacctccaccccacatcccactccttgcctgtaaattgcctgttttctgattttatttggagtgggactcagtatttctcccctacttcaaaaccccgttgtagtagcttcccttgaatagtctttcttgaaagtctaaagacatctttagcagatgtcattaataatttgtttttaatattctttttttttcagctcactgtagcttcaacctctcgagctcaagggatcctcctgcctcagccttctgagtagctgggattacaggcttgcgccaccatgcccaactaatttttttatttttagtagagacagggtctcactatgttgcctaggctggtctccaactcctgggctcaagtgatcctcccacctcggcctcccaaagtgattggattacagatgcgagccacagtgcctagcctgtttttaatattcttttttttttttttttttttttttgagatggagtttttcccttttgctgcccaggctggagcgcaatggcgtgatttcggctcactgcaacctccgcctcccgggttcaagcgattctcctgcctcagcctcctgagtagctgggattacaggcacccccccatcatgcccagctaattttgtatttttagtagagactgggtttctccatgttgttcgggctggtctccaactcctgacatgagatgatccatccgcctcagcctcccaaagtgctgggattacaggcgtgagccactgtgcccagacctgtttttaatattcttaaccactacacatactcctctaatgttagacaaaaataaaactcataagaaggactccagtaaatgccataagtcattagggccaagcagcattgccctggatcatttctaattgggtatcaaaataaggcaagaaggggagagaacaattctctgttttgtcctacaccatagagtagcttgggcttacaatggcaaccatcaaagctagagggattctttggagcccaggctgggggcagagccaccagcagaagagagctctatggcaggaatgactagtgcctagaagagtagctcagggatgcctgaaagctaaaggagagaactcattcttgagaaaccctggaagaaccactgagaccccagctgcctgcagagacatttgcacgaggccaagactactgatgggagcaggtggggccagcagatgctggggtattccgattgcccagcctggtgagcttgcaagaaattgtaaatatttccctctttttcgtgactcgttacagagaggcgagatacaattttcttggagtgggggagcagagttgaacaagtccagtttactccgatttcaagaatgtttctattaggctaaagaagattcaggatgcttcgaggagggaaacgatttcaaggtgaccttgtggaaggagccggcactatgaaatgtttttgatcgagtggaacaagataagctgttcatgttgcggaagggttcaaagccctggacaccagctgaaataagaaaattcaatttctggcataagattgtgttttttctgccttctagaagaatgtacacatctgcccctcttctctccctaatgaaagcatcgtgttcctctgcagtcgttccgacacaaacggggtcgtaaaggcaggtttgcatggcataggtgataccactggcaggtactcagacacagagatggctgtttcagtccagaggcttctaggaaacttcacacatggccagggctgggaccagggagcgacccagggctattttgatatcattgtgttttcttttgttctcccacaaaagactcctccatgtttatcgaaaacattgctgtccagtagaactttctgcattcatggaaatgttctatgtctgtaatattcagtagggcatctccaaccacatgtgactcctgagtacttgaaatgtggccagtgtgacaaagagattcaatttttaattttatttcattttaattaatttaaatagcctcgggtggccagcagctatctcattggatagcacagtgctgaaagactcagtggaaagggcatgatcctcacgcccacctagattgggcttgaattctgcctctatcatttgctagctgtgtgaccttgggcaggtttcttaacctctctgaccctctctctcatcctcacctgaaaaatggggatgatgatatcagtgttgcaggattttggtggaaatgagttgcatgcacagaatacacagcaggccatgtgcaagtagtaaatcttagctgtagttattaattcataagtatgtctgtggcttcacaattgacttgggatttctcagttgtggacacgaactcttgctaacaatgacggggcaaagtggaggtaaggaatgaggggtcttctgtgttggaggcaatggggatcctgcagggctcaaccagcaggatgagctcagactcagggccccccaacaggcagaaggtggacttgaggcattgttgggcgagcaggaccagccagctgcccttccccgcccccaccagccgggcctccctgattaccgccaaggtgagaggaggcccctctcctaagagggcaaggatgaggagaagcagacagggagggagggagaggagagcaaagatgtgagttcattgcaaactcaggaaagactgaggacagagagacagggaccaagaaggaaacagatggaagcagggacaacagaaagcaaaggagcagacaggaggccatgcacagagccaggggcagggaaccgcaagggtgaggcgggcagagacacacaggaagccagggacacagacacagagaccaagacacagagacagagacacagagaagacacagagacagagatatggacatggagacatagagactgagacatggagacagagacatagatagacggagacacagaaacacagactgagataaagggacagagacacaaagatatagagatggagacacagagacagagacacagacatggagatatagagacaggaagctagagacacagagagacagagacacagagacagaaacagagggagagagacacgggaacatagacacatgaaaatagagatacagagagacagaggcagagacatggagacagacacagaaatacagaggcaggaagacagagacacagagagatagagacacagacagagacacaggaacacagagacatgaagacagagacaaagagacagaaagacacagagataaacacggagagatggaaacacagagacagaagacagagatagaaatgcaggaacatgaagacagagacagagagatacagagaaagagacagagacacagagacagaaatggaaagagacaccgagatgcagagatagagagactgatacagagagagagatgcagagagtcagagacagagagacaagcaaaaagaataagtgggatgggggacagggcaagacagagcaagaaacataagtcacacacacgcacgcacgcacacacacggacagagatgggaagacaggctgagagagacaaagcaaaacatagacagggaaataaaaagatgagagaagagtgagttaggaggaggcagggaggaaaagctggagaaggcatggatggagtggcacagggggaccgcagagacccacagcaagacggaaatacatttcaaaaaagaaaagcaagaaatggaggggcatagatgtggctgagtgccaaagggagactggttggcaggggcggggctgggagggaggggctgggtgggcccgcagcagcggggcagaagcagctccacctaggctgggggcttgcatggtgtatccccgtgaggtttcccaccgagccctctttgttcctccacctcctcctcaccatcaggcagagggcttgggaacttgggggcagccaaggattccagagcccccctcgcccgcgctccttccctctaactcgggagtcgttaatcttggagggcaggttggtcttttattagctatctccaagggtcagcttagaagtatctgagaagatactggttcagaatgtcatttgtcatctggaggcctgacgggtggccgcatcgactcagccccctcctgtcctccctggaatttaggaaagcgaaagctgctcttaacctttcccttaaatggagctttaattcctctctccttctctgtttgctcatcagggcagcgctatgggaacaataggaagccacaggcaggaaggggggattgctcctcccagggaaaggtggggtgtccctgctccttgcaatgcctccctccccacttcccagccccccacatcagctgttctcaagcttggttgtatgtgggactctcctaggaagctaaaaaaatggctgagggggccgggcacagtggctcatgcctgtaatcccagcgctttgggaggccgaggcaggtggatcacaaggtcaggagttccagaccagcctgaccaagatggtgaaaccccatctttactaaaaatacaaaaattagcagagtgtggtggccggcgcctgtaatcccatctactggggaggctgaggcagggaattgcttgaacccggagggcagagggtgcagtgagctgagatcatgccactgcaccccagcctgggtgacagagcgagactctctcaaaaacaaacaaaaaaagatgctgaggcctgggctcacccacagaggttgaaatttcattgctctgggctgaagttcagacattgcagcgttcaaacctgtcctcaggtgatagtaatgagcagctaagacgaaggtctgctgagctagatgatcccctacctgccttttcatcatcatccagtctcaaaccaggcaacacctcctctgagaggccttccctagtaaccttcccttgaaacaatgcctgatcacaatcccccattcatctgctgccaagcattagcagccatctaaacagtgattaagagcctggcctctcaagccagcacatgtgggttccgatccccaagccactcctccatagctaggagatctcgggccagtcacttattctctgtgcccccaattcccccttctgtaaactgggaatgataacgctttcaaggattctagtgtggattcaaggagccaacaaaggcaacgtgcatgggagagtgcctggcacagagtgagccctatattagtgtttgcaactgttattaccttgctttttatctcctcttgtttagctcttcctgcaagcttccttatggactaggccatgattatcatcttcatcgtccccattttacagatgagaacactgaggcatgagagagtaagaaacttgggcaaggggctaggtttcaccatgactgtttgactgtggccctccagagctagtaagggtagaagcctgtgcaagctggtaagaggctgggcagttggcctgttttaccctggcctgtagggcttgagctttcgtggacatcagcacagagaaagaggtgttccagttggaggaagcagcttgttcagccataggaagcagcctggggcttctgggaaaggtactggctctgggtggtgttgggagtgggaagaagttggggggagtggaggcagggctggcaccaagagctctggagggaatgtcaaagatggagagttgtgttgaggttttggttctgcgtccacatggagatggagaatgactggaacgcaggtcccctaacttccggtccttgggtcttgcccatggaccctggtctagcgcttcgaaatcgtagacaattgggatccgtgtctgaagttggttgggtgagatagttctggggtcaaacccctctaatctgggctgcaaactcaacacctccactctccagctgcatggccttgggtaaggtccatgacctgtgtctgccttggtttcctctcctgtaaatggaggtgaggaacctccctcagaggatgtggtgaggactgactgagacgaggcatgaaaagcatggagcaccctgcccgcctgagtaaacaaaatactcaccattgctgacactgacaaccatctcctgggtgggaaggatgaggagaaaaatagaacagctggaaatgattatgattgggatgtggcacaacaaaggaaggaaggaagagaggaaggaaggaggggagggaggggggaggaaaggaagaaaggaaaggaaggacggatggtgggaggcaggaaggatgaaaggagggagggagggaggaagggagggaggatggaagtgagggaggaaggagagggaaagggagggaggcagggacggagggaggaaagaaaaaaaggaaagaaaggaaggagggggaaagggagggagggaaggaaggaaggaaaaaggaaggaaggaaggaaggatggaaggaaggaaggctggctgagaggttttcacagatgaatgattttcagtggtaaaaccagggaagtcctaggcaaatagagatgagttagttgctctaaggaaaggtctaaagcagtacactttaattcttcaagcgcaaagtaagtcaaaagaaaagcaaggaaattgagtcaagctacagcacaaccaattgaggttagatctcatacaggacttcctggctactgaacaacaggcacgggtgggcgcgccctttagcaactgggaagaaagctcagagttcaggaggcaactaggagaaacggcgaagcgcctctctggggatggaaggtccgtgttggctgctggttgccctctgtgaccgggtcagctctcctgtgacccatcgtcctcggcagagccagcagtacatttccaaatgccagacatcagaggctcaggaaagatgctcagcccgattccgacagagcaggttaggggcaggcatatgcttggtggcacgcagcctaatctcagagaaagtgttctgatagaaagattcatgatagccatccgggctgcagacaccaggccttaacttccaattccaagagccctgcggtgcacgcctcttacccggcggctggcattgcagcaggtctcaggccaggcagatttacagcatattatcagcaaatgaatgtcacagctggtctttgtgcttcagaggaaaggaaaagaaaggaggacagttcagaaaaaaaggaggcttcaggatccagatgattctgaatccctttctaaccttctgtgtagacaggctggagctacagggtggggtgggcataagaaccctgcagccattgtctacagaaggcactgaagtctgcaggggtgggtgagcgcaatgcagcaaaccagggtgtttccataacaaaggggagcatgctggcctccccactccagcagaaagggctgggaggagagaacagtatctcaactctgcagctcaaacacacttcctcatctgttggagcacggtggtccaatgtgtctctgacgcatggcctcctggggaccacaagggggtaaaggaggtgactttagggtagggactcccaggatcacagcctcttctctaattccaggcaggaggacagggccataaaaaaacacaagttctgttttacttttctccaactggctataatgaaaaggttcaaatattcagaaaagttgtaaaagtaatgcaataaatagcacctagattcaatggctaatatttcgttagcaatgctctatcatacctgtttgatgtatgtgtgtatattctttctgcactatgtgaagttgcagtcatcgtgattcattacccctaaatacttctgtcttctaggaaaaaggcattctcccttctacaaccacaacaccaattatcacacctaagaaaatgaaaattctatatcatctaatatccaaattcaaatttcctcatttgtcccaagaatgcatttaacacattttcaaaaatgcattcttgtgacacttcgatcaagatccatgcactatatatttactatgtcgttgtagcatcttttaatctggacccgccacaaccccctctacatttttattacactgattttatgtagagtccagttgtcttgcagaatgtcccacattctggatttgccagattgctttcccatgttgtcgtttcacttttttctctgtctcacatattttctgtgaactggaatttgagcctcgatatgatcgaggttcgattctagttaatttcgtgaattagatttatgctttaccttttcagcaaggaacctttttagagggcactctgcacttcatatggcattacattactacattcagtggtaaataacataagggtgtcacgctatcaatgaagaaaagtgtgtcacttggttaaggcggtgacagctggtcacctattgtgaagacacactttaccctcctttactttacaaagatagccatgattgaggttggaactaggcaacacctcttttctccaccaatctttctccaaatggttatagcatctattgctaacacctgcctgaaatacttattaaactgcaagtttaaaaatgatacttttcaccactgataggtgtatatattcacaagaaaggaaatcagcatatcaaagagatagccccactcccatgttggttggagctgttcacaatagacaagatttggaagcaacctaagtgttcatcaacagatgaattgttgaagaaaatgtgctacatatttacaatggagtactacgcagccataaaaaagaatgagatcctgtcatttgcaacaacatggatggaactggaggacattatgttaagtgaaatacactaggcacagaaagacaaactttgcatgtttccacccatttctgggtgctaaacattaaaacaattgaactcatgaagacagaggagaagaatagttaccacaggctgggaagggtagtggcagagggtggggatgattaataggtataaaaatatagttaaataaaatgagtaagacttagtatttgatggcacaaccgggtgattacagtaatttattatacattaaaacttttaaaaataactaaaagggtctaattggaatgtttgtaacatagagaaatgacaaatgcttgaggtgatggataccccatttaccctgatgtgattattacacattgtatgcctgtatcaaaatacattaggtaccccataaatatatacactactatgtacacacaaaaactaaaaattaaaaaatgatactttttctgtctttccttctgtttctccttctgtattagctggtataagaattcttggctgggcacggtggctcacacctgtaatcccagcactttgggaagccgaggagggcagatcacgaggtcaggagttcgtgaccagtctggccaacatggtgaaaccccgtctctactaaacatacaaaaaaaaaattagccgggcatggtggcatgcatctgtaatcccagctactcgggaggctgaggcaggggaattgcttgaaccagggaggtggaggttgcagtgagccgatatcgagccactgcactccagcctgggtgacagagtgagactccgtctcaaaaaaaaaaaaaaaagaattcttaaataagttctttcgttttctttccctcttctttctaaaagtccctataggcttagaaattttagccattcaacatataacagacaacttctgtcatttctcaaactaaaattctcccaaatttggctattgcgagccccacaaacctggatttggggctcttttgacacatttccatcatttttgacacatctttgctttctgaaacaattggatgacccaagctcacttcatacatctctaccacagacccggagtaaatcattcctccaaagaatgaggctcctttcagcagggggtggcatttttaaaccaaaatctgggcttcagatgtgataagcacagattctgctgccagataacatgggtttaaatcttaatccaagtagggcatggtggctcacggctgtaatcccagcactttgggaggctgaggcagcagaatcgattgagcccaggagttcaaaaccagcctgggcagcacagtgagactctattaaaaaaaaaaaaatagccaggtatagtggcacatgcctgtagtcccagttactcaggaggctgaggcatgataattgcttgagcctgggaggccaaggcgcgcggatcacctgaggtcaggagttcagaaccatcctggccaatatggtgaaaccccatctctactaaaaatacaaaaattagccaggcgtggtggcacatgcctgtagtcccagctactcaggaggctgaggcaggagaatcacttgaacctgggagggagaggttgcagtgagctgagattgcaccactgcattccagcctgggcaacagagtgagactttgtctcaaaaaaaaaaaaaaaaaatgtctaattcagccacctactagctgtgtggtctcatgtaaatcacctcacagttctgtatgtcaattttctcatctgtagaatgggggtagtaacaataatatattccactttgttacattgttaaaaggattaactatgttcctctttgtgaagccattcaaacagtacttggcacccagtgagtgctatacagatgtttgttaaatatatatgtggccttacaacttatgaagacgggggagagggtggaaaagaccctcaggcatcctgagacagagacagaaaattctttttaaagatcttattcaacttggatgaacataagtgaaaatatcattatgtttatttttactctctttccatctattaatggcaagtcacactgacatgggaactgatttgacatgtggagtcttgaatcaaaatttccttcctaataatgaaagtaaatttttattcaagtaaaatagagatgcacaacaaagcttccttttaaaataagcgtattttttaaaaaatcaaatgagatgatttttaaaaaatgactaattcctaacagctatgaaatgcaatatgtcaaaaatgaatgatgatggaatgacagcaatcaaggtttgggcaatactctaataaagatgcctgggagggaatccttattcctattgtttggaaagatgtttcattttttaaattaaaataattattttaataagctctggatgcatgtgttataaggtccaccaccatctgagtccttcaaggctgaagatccaataggagagcgcaggagatctccatgagacaacagaaatgaagttgaaaattcaccttaatcatattttccccacctgcctttcagtgaggagatgtgggtggaggaagggctgaaatttccaggagggctgctcctgggagaagatcgtatagccctatgtggggtgctatacatgcccccacatatatttctatatgccttggtcataaatgcttatcccttggattttgcataaatgcaaaaataaataagtgaagaattaaaaaataaatgctcatcttaaacacagcatcggaagccatagaccgtctgcattgcgggttctctatatatagaatgagaattccctttccatccacaatcacctttgacttcttcgtattaaaacctggaccccaaagagcagcaactacaaaatgggattcattgaccagcagttcacagaggtccaaaaacaaacttagttaagagccgagggtaggaagaggcaagaatcaaggatggccatgctcaagcagagagaggcaaaggaaagcaaggatggagtctgtgtgtggtgtttgctgtattgacggacgttcagttttatgctttgacctccagtcaactcatcagccctttcatgagtatctatcacgtgccaaaacccagaggaactcaaaagaaacatcctacagcattacctaatgattccaaccattacatgtgctcttttcactgatagccctggctggaaactgaggttttaatcaggtggcaatttcagggtctttagagaaccatcctatgagaagtcactgcagggtgactatttcttggaatttgtagatcatgaaaatgggagtagtgccctagcctaggctctcccctcctccccttattctttccttcagtcacttattctcatgcagcttcagaagatggaagttctcacaccgccgtgaaaatgatcagctggaacgggaccctctccagagtacatttgagggtacggtagatgtaaagtggtagtgttttctcaaccaaaaattgagacatgcgatctgccaaaaataagtccctgtggggacagagagacaggctatttttaaggtgggactccctccgaaaatccggggtggaagctgatgacaattgtagtggggtgttccctctagtgagttttgcacaagtgccatttagcgtctgtctctgtgcttttctcacatacccaaagcatctgccagcagttgtgtctgcatgtgctttgcaatagacagggaagggagatgcgagcccagaactctttcctgtatgtggaatatagaactcccaggcataaacaagccccatgaagacagaatacgataaggaggttggcagttgcagtgggatgtcctgatttttctctcctctggatccctgccctgaaataatcagaagaaagcttctcaagttgatgtctttatagagtaatacctggagaaattttttaattttaaattttcttaaaatgccaaaataattaaggataatagagtccctgctgtggaataagaaccattcaattagttgaagtacactcctgtcaatcttgtaaacaaccggggatataaaattaaggacagccacaagagaatgaaaactgtgaagtcaggatctgagggtgctgtttctgcaagtgggcattcaacaaacattagttcataaatgaatgaatgaatgaactctacctaagttgcaaattaagagcctacatattttctttatgtcttttacattagatttgtgaagaacaaatctgactgattcagtccagactatgcagtaattcatcttggatcacatgactcactccatccattcagctgtggccacaaggatggattctacagtagaaatagcactctaggatcagggatgggtagggaacttccaaagaaggaaatatggatagagcaggcaccccaaaacttgatctcagccttcagttctttgctaagggcatgacaaggattattcgttcagtgtggctaagggaattatcctggtctggtttgcgtgatcttcggtggctcccatatggttttagtatatgttggaatggttatgttttgcttctgttctaaagccctaagtttgcttctgaattacccataatagtgcagatgcttgctttcttccaatgcattttgttgcaagatttgagctcactctctcgcaaccccttctcctccccttctccctttccctttccctcttgcttcctctctttggttctcctccctgccacccaagtactttgctgccgcacctctgtactgtttctcattagagtctttcctgcagaattaatattcttctgtggaactcagggagggctggttattgtgtttgggtgagaagggttcgttattcttctttgaaatctgagctataaacaggctccctgttgcatagggaaatgtagccatgatactttttgtataactataatgctattacgtattcccccagccctagaaaatgcaatgaatgggcattatggtttaatcactcttttcccagtgttatgtgtcctgcacttatacataggacacttaatataaggttggttatctatacaccatctagtcatgacaatgagaaataggtctgagtctcatgtttacaacagtataacaggttagtaaggtagtactctatcaaatgatgttggatcctcctaagggcacatacagaattgtacttcttcactcttttgatgttagacatgagcatgtgacttgttttgtccagtgaagcatgagcagaaatagaacatatcacttacaaatggaaatgttaccagccaatgtgtgatttttttttccatctactttttacctctaccacgctggcaacactccaaagtagacattccataggcctggatcttggagctaggagaaccttcagtaacttctgatagaccttcctctaagccacagcaatatgggttgtttgttactgcagcaaaacttagcctatcctgactgatatatatatatttatatataatatatatatttttatatatgtaatatatatacttttatatatgtaatatatatattttatatattatatattatatacatataataaaaatatctcacacataaaaaaatttctttcatgaatttatatatctaccatccatctgttcaaatacatattgtgcactttctatgcaaaaggtgtttgaataaaagagaattgattgtaggaagtgatatcaaataggacatgtgagatatatatatatatatatatatatatatatacacacacacacacacacacctatacatatatatacacacatgtatatgtatatacctgtaatatatacctgtaataggattgactatgcgtaaggcacagtgctaagtattttgaatgaattagtttatgagatttttttaattaaaatactttttttgagacagagtctcactctgtggcccaggctgggctggagtgcagtggcacaatcatggttcactggaccttccaggctcaagtggtcctcccacctcagcctttcaagtagttgggaccacaggcatgcaccaccatgcctggctattttttttaaaatgttttatagaatcagggtctaactatatcaccccggatggtctcaaactcctgggctcaaatgatctttcggccttggcctcccaaagtgcccagattacaggcatgagtcactaacccagccttaactttttttttttttaatcataagaaccattttatggtttaggaaaagaaacaaaaaactaagaaaaaacaaaacccgagcctcatagagtttctgtctctcacccagcattgcatagctaataagtcacagatttgggtttcaaaccaggtgtgtctgcctccaaactacttaatcactatgctatattgcctctttccaaacactaagatagttttgtgtttcctcagaaaaccatgagaaagcaaagaaaaataaaaactctgccctttcagatccttgcagccagccaggctctccgggtttggtttgacaggttgtcttcccttcaaaatgaaaagagaggcacatggacagaaataaaggccagctgttcagtggagcgagatacctgtgtgcacgccagcagagccaggcgattatttcaggagccgctggagttggcggctccgttctcgcctccatccaccctggatgcgtaggccagggctgacattacccaaataagggagaatctccccagattgcatgtttgtatacagacttaggaaaatgtgagagattctggttagaacacactgataccatcattaatcaacaaccagggagagaaattgaagggatgaaaaggtaggttcttgtacaagaaaaagatttgtgggaagagattagaaatattgagaaaccagagaatatttttgcaaacgtttttccattcttaaagtttcaaaagttaaccaataaaggcagcccccaaagaactcatgtatttattcattcatttgaaaaattactttctgaatgtttgctgtgtaggtgactgagatgtgaagatagaaacaacattttatggaacaaacacttagataaaacctactatgtatcaggcatgattccaaatgctttacatgtgttcattcattccatactcatttaaaaaattccagagaggtagctatgcattatctccattttgcagaagaggaaactgaggcacagagagttatgtgttatcttgctcaaaatcatgcaacctttgggatttttttttttaaatggagtcttgctctgttgcctaggctggagtacggtggtgcaatcttggctcactgcaacctccacctcttgggttcaagcaattctcctgcctcagcctcccgagcagctgggactacaggtgcgtgccaccacgcctagctaattttttgtatttttagtagagacggggtttcactgtgttagccaggatggtcttgatctcctgacctcgtgacccgctgcctcgccctcccaaagcgctgggattacaagcatgagccacctcgcctggccagcctttgggatttgatccctggtgggtctggcttccacactgtgctgatagcatactacctcacagggtcttggtcttcaagctcgcatgtcagtagagaagagagaaagaaataatcttttttttttaaattttattattattatactttaagttttagggtacatgtgcacaacgtgcaggtttgttacatatgcatacatgtgccatgttggtgtgctgcacccatgaaatcatctttttttagagtgtgaagcctgttttgatggagagatctgaggagaaagaattcagttctacttgaggacttcagggagactcttaaatgcttacatgcatttgttagcctggtgggcaagtggagaaaagggccccttaggtggaaggagtggtttgagcaaatgcagaggcaggagacagcctaggctcctcaggaaagtgctgaggcatggaatgtgcaaaggaggacagcaggagataaagcaaaaaagggtaccaggtcagaggaaggaggtgcgcctcttccaactaggcactgcaggggttgagcgtctgccttctgcaatgctgatgcaccagtggaaaagcatccgctgctttgtagatctctcccagctgtgctgttggaaaggcacccggcagctgagtgcagggctggctgggagggtaggtagcagagctattgagagagggccctttaaaatcagacccctctgagcttgaatctcagctctcagttaccacctgagtggtctcaggcaactgaccaaaccttccagagcctcagctgccaaatgggttgctgcaagggctacatataaaaagtggttattactagatctggatgtcgatgttccacttaagaggatgttactatacagtaggtgaaggtagacacatggcagtactgccctgccatgaacagggttgtttctcccatctcacagtgaaaaggaatttgtttgccctgatttatccatgttaacacacagagcttcctgaaagaccaaatgcaaggtgaagttgatgtgcagtcagcagagccaatcaaattggctgatgtgggaaaccagctcacactctccatctcaatcaagcgctctaatccagagatgttccagctttaaagcacacacaaatcactgtgatcttgttaaaaggcagactctgactcaataggactggggaggagcctgggattctgcatttcccaccatctccccatgctgctattccattgaccgccattggcatagtctggccccaatccgcaagatcactttcatcatcctaagacctaagttatcaagcccaagagtgaaaatgcaacccaatgcctctcattaattggcttattctctcatccttccgttaaatattttctaagcatctactatgttccaggtcctgggaaaatacagatatatacaacataggccctgtactcaatcagcttgcccaccctatgcacatggagaaggaaaagagaaggggactggccatttggggggtactcacttcacatatgacatctcagtgaattctcccaacattctatgaaattgcaaccattcaacccacattagagactaggcaactacagcctgccgagtaaggatagctcagggctggggcgcggtggctcacacctataatcccagcactttgggaggccgaggtgggtggatcacctgaggtcaggagttcaagaccagcctggccaacatggcgaaaccccaactctactaaaaatacgaaaattagccggatgtggtggcacacacctgtaatcccagctactcaggaggctgaggcaggagaatcgcttgaacccaggaggcggaggttccagcgagccaagatcacaccactgcactccagcctgggcaatagccattgttggcattgggatttgaagccacatcttttgattctgagatcactgcctcgtttatacttaactgtaagttgttgattgtgttctctttttatttactttgagcttggctgtgtctctttagttttagagagtgaacttttttccctcataaatttaaatgctgacataaggaggaaaaatcctgctgtaattgaacaaaaggatgtttacaaccttctttgagtcatagagctcctggcacatgaaatttatgactgcaaggaaaggggaaataaaaagaagggggaagaccaagacagatgtaactgtggaaatggtgtgctaatgtatgggttgacattctgacacttgcacattcagttgggtaactttttggaggccatttcaccagctaatgaagatttacttaataaactctcaaacttgccagagctagactctttaaaacaaccctataaattacaaagatggtggcatgttcaagagaccttgcagttgttaaaggatggaatgcagttgccagagttacaaaggtcattgtctaggaatcttgtgcccgtctctggagggctgagggacctttcaaaggactggctccgatgtgtgcaccctatccagataaatgcatacagatgttctttgaacttgatcaactcgcttctcagcatgaatgcaaaattgattgggccaaatcagagctcgtgccagtgaaggctggctgcatacagaaataaaatcagccacctcccatttacttagaagtctctggcttaaaatacattggaggaaaatgtgcgcttcacgttagagcaggagccaaattgcacagcgacaaaattattcccatcatcatgacagcctcagccaatcgtttccttttttaatgtgctgaaaggaggcaagttggcatcattaaaagtatttttttctcaaaaatacatcatgaaatatggagaaactagaaacagaagaagggggcccacgcataaatctaattctgagaccggactatggagattttctgttctggttgcactacgaaggttctaaggaaagaggttgtattttttgcctcccgcctctcttgatggcctgaggttgatgtggatgtagattttttttcctttaattcagctcccgtttttcaagcagtgcccctttcactgaatgattatccccagtaacctttgatcttcactcttccttgatgaaaaactgcaactatatcatgtctttttgatgtggtctttcttaagtactgagtcaaggtgatcattgatcctgcacgccttcatttcctcttcccaaatgagtccagtgttcccttcacccttccttctgtcttttattacctaacgaagttctagaagccaagccaggatgctctgatgtgaaaactgcctaaaagggaaaggttaaccctgaagccagtgctcagccagcctgtctgagagatccctgttcctgagccataaagcgatgcttcttcatacccatttttgtccttcagcttctttctgtggagaaaaaaattttttctctaattcagacccagcaaattggtgtgctcctaacttagtctcagaaattctgatttccagatgtcttatgccctttaatatctgtttcagattaccaacctcaccactgagaactgaaagcatgtgtttcttcttctgtgctaagttgcattttgttcttttttcaaacctcatccttagaaattagactttgctgtctttggttgtttctagtacacaactgagatttcctttccagcaccgtgacttaatatccctttctggaatattacttacggagagaaggagtaaattcttcaagattttgaatattctataagactatgtccccatttttacttcagaggaaatcggtcaccattgattttaaggatgaaagttgcacagatgaagagggagcatattattcaaatcaaagcccagtaattcagggatgatcaaaggtttcatctcacatgtcaagtcaaataaatgggtagtgttgtctggcacgctgtggtgagaaaattctgaggctgggttcagacaggatgagaaaatgtggtgaaaaagttcagtaatgtccgccatgggtgatacgttaggacatctattcactttttaaaatgctaactcttgcataagaaaatccacagtttttctgatatacctaccagatatattttaaagaagtttcaagaaaaagtcaaaatttccagggcaaactatcaagtggtcttcccctaaagcagacacttctgtcaaaaggttttattacacacgccaactctgattgataaatgattgtcaggacggctgggttaatctccataactgattagtaatgtctaccacagatgaaggcatggacgtggtgctacatgtacccagtattttctctcctggtttagctcaatatgccatttactctgtcttaggaaactaataaagcaatgaagtttttgaaggcatcccacagagtcagggcatgggttaatctctcctctgttagaggagaagcagaaataaactgaatcaagcaaaatgttaacaaccctgcacccaagatttagaacacatactttctcccatcgcatatggaatatttacaaaatttgaccatatattggccataaagcaagtatcaatagaatttgggccacattctaaaaccatataggaaaataaaagtaaaaccccttctatggtttgaatgtttgggtcccctctaaaattcataagttgaaacgtaatcctcaatgtgatcatgttgggaggtgaggcctttaggaaataattaagtcatgagagcagagccctgatgagtggattaaagccataataaatggccaagttcagctccctttgcctctgcgctcttctgccacatgaggaataatattttccccctccagagaatgcaggatttcaggtgtcatcttgagcagaaagaccagacaccaaacttgccagcgccttgatcctggacttcccagcctccagaactgtgagaagtaagtctctgttctttacgaattacacagtctcaggtattctgttatggcagcacaaaatgaactaagacaactccttttaaacaatttgatagctatgtgaaaaactcactatatatttgcagttttaaaaacatgcttctgaataattcatatactatctgacgtaatttatttgtgcgttttttgcctttcctcatatgaatgcaagcttcatgaagtcgaggagctatgttcattgtactacccacagcatatatacagatctaaccttgtttcagtaggggcatgctgaataaatgaatgaatgaatgtcaacacttaagatattctatttatgaagtacttgaagggaaatgtgtaaccttaagtagatatattagccaggaataaagatacaatatgatttaaacatttaccttgggatattaaaaaataaacagtaaattgaaaaaaagaagagtcttttaaatgagcacagtttagtggaacgtaaataacaggaataagaagagaacaaaacaattatcagggccatttggtattttttttggcaaaatctataaattttcaaggaacaaataatcctatttcttataaaacatttttaaaagaatagaaaaagaagaatggaggagttgattttgtaataaaatatagcctttatatcaaagacaggcaagaaaagttatgtcaatctcatttatagatttatgtgcaaaagttttaaacaaaatattggtaaacaaaaatctagcagtgtgaatagaaacaaacagataaccataaccaaatagagtttgttctaggaatgtacagacagtataacattagaaaatctattaatgtaagttattatgtaccagattcaagttgaaaaataaccatcttcatgtagacagaaaaaacattcagtaaaatttcacattcattcatgtgttaaaagaaaaatgttagcaaactaggaatagtaggagaaattcttaacatttgaagcaaatttgcacttgatatgactgtctatatgtgaaaatcaagactatctagggcaaactatcattttttaaaaaaaacattatgaatacaaagtcaaataaaattagcatatttgaacactatcaacaataagttagaaaacatcattttaatgtcttattcataatagcaaacagaaaataagcttttataggataaatgtattgaaagacctgtcgttatagggacaaatataacatttaattaaaggatagaaatgaagatcatttggagaggaacaccaggttcatggaaaaaagcactatgataaagatggaaatgctccagattgatctatacaaccaatacttcaatcaaaattcaagcagatcatttttcataacacttgacaagcagacccgaaaattcacaaagacatgttgaagccaagaacagccaaaacaattttgaataagaagaacaaagatgaaacacctgtaagatgttaagactggttataaaacttaaataaaagagtgtggatctggtgttgagagagactattagaacaatgttaaaaatatccacgaaaacaatccagaataaagatgatgtttgcagtaaacaaaactgaatatacaacaaattcctaaagtcagtaaggaaaaagacaaaactgagtagaaaaatgggcaacgcttgtgaatagcaattcatacctgaaggaacacaaatcttccataaacattttgaaaaggtgcttagggaaatgcagtttttaaaatcatctcatagccattgaattatcaaagtttcttcataaggatgtggaaaattcatgttttgatacagctggtgggagtagaaatttatacaaccattttgtaaaggaatgtggagttatctgctttgttacgttggttctaagacgttcctcctccacctccacacgtactgtcccccactgccacattttaacattgcctaaatccaaatccatcttacagttgctgctttcttaatattttaaacaacattttgggtgcaacttacattagatggcctgttaggtttcataaaataagtagtaaatttgaagatgttcacccttttggatccagccatttgattcctagatgggtttctagaaaaactcacatctatacacaaagacatatacaatgctattcattgtaaaatttgattttcttttaaaagttttgctctaagaagctaaaaaattggtttctttcatgcttatttcagtaagaatactgttgcctacacacagagaaaaatgtattacttcccataagaggtcgagaagagttgtttaatttcctgactcaataatgatctcaagatctcagatttatcctatttctctgctttgccacagttggcttttagacccatttatttatatttgctcacttcctgatcacaacttccctaccttaacaagtgcaggggcttcaaatgatctcattattgctgctattgttttattttaattttgaaataattgtaggttcccaggaagttgcaaagatagtacaaagaggtcttgtataccaatcacccagtttctctcaatggttgcaccttccacaactttgaaacaatgtcagaaccaggaaactgacattgctacaatgtgcatgtatataattttaggtcatttgatcacatgttcagattcatgaaaccgccaccacaattatttaaaaccaagatggggagctattccagcaccacggagatttctctcatggcatccctgtacagtctcaatcatctccctaattccgaacatcacctaattcctggaatttttgttttccatctctaacattacatttgatagtaagacatagcaacttactttgcaaagcagcaaaaaataagatggatggatggataaatggacaaaaggatggagatatatggagtaataaggcacatatagcaaaatgttaaagaatctgggttgagggtatatggttgttcagtgtacaactcttgacatttgtctatatacttgcaaattttcatcaatataatatgggaaccaaattgatctaaatgtccaccagtagggaaatgaataagtaaattatagtatacactgtaagtatactatatgtctataacagatgattctatagcatttaacaagaaggaactagatcttcatttaacaatatggctaaatatcaaaaacagtatactgagtaatgaaaaggtatgtttcagaataatgtacatggtgcaactgaagctaacacctacaaaatatcagaaaggtaaccacccctttgaagtttttgttgcttgttttcataaatgattatacaacaacatcatgggtgacacctggatattgtcgagaacatgggtgcatgctatattctttttacttttcatatttgagatgcattactattaatgaaaatttaaatcaaaaaagaaacgccacataggtccacatacggtggaagatactggctcaaaattagacttcagagaagtgtgagtcaccttctacacattccttttatagtcgctcaaattatgggacacatttgccaattactttactttaaagaacaaggtactttgggagaaaacacattattctgaaacgacctcaatcaatgctagctttggatgtttatagaggtcccacgacagaatcagtaaacaaagaagcaggtaaatttaacacatttagtaattattcctgggagtatggccttaccactgcaagtgttggttaccatgataaatgaaacctgtaaagctacttgaaaatgaaacagactaagagcttgtattttgtagtcaataagcagatgtacacagaacagatgtttttttaaaaagctgttcatcatatgaaaaaaagctcatcatcactggtcattagagaaatgcaaatcaaaaccacaatgaaataccacctcatgccagttagaatggtgatcattaaaaagtcagaaaacaacagatgctggagaggatgtggagaaataggaatgcttttacacagttggtgggagtgtaaattagttcaaccattgtggaagacagtgtggctattcctcaaagatctagaaccagtaataccatttgccccagcaatcccattactgggtatatgcccaaatgattataaatcattctactataaaggcacatgcacacatatgtttactgcagcactgttcacaatagcaaagacttggaaccaacccaaatgcccatcaatgatagactggaaaaagaaaatgtggcacatatacaccatgaaatactatgcagccataaaaaaggatgagttcatgtccttttcagggacatggatgaagctggaaaccatcattctcagcaaactaacacaggaacagaaaaccaaataccacatattctcactcgtaagtgagagttgaacaatgagaacacatggacacaaggaggggaatatcatacaccagggcctgtcagggggtggggggctagaggagggataacattaggagaaatacgtaatgtagatgacgtgttgatgggtgcagcaaaccaccatggcacgtgtatacctatataacaaacctgcactttctgcacatgtatcccagaacttaaataattttaaaaaaaagctgttcatacttttcttatcacaaaatttaagataatgtttcctccagggaaaagaatgagttttgatcttttgaggacctggaaatatgctatttctttttctgggtggttatgacagttgtgtttgctttataattatacattgagccattcacatgtgttgtggatatctttgtattttattattattattattattattgagtcggagtctcactctgtgacctaggctggggtgcagtggcacgatctcagctcactgaaacctctgcctcctgggttcaaacaattttcatgcctcagtcaccaagtagctgggactagagttgtgtgccaccatgcacagctaatttttgtatttttagtagagacggggtttcatcatgttggccaggctggtcttgaactcctgacctcaagtgctccacctgcctcagcctccccaaagtgctgggattacaggcatgagccaccatgcccagctatttcgttatgttttacaataaaagaaaaggtgtcctaaagttgtgcaaattagtacttgcgggttggaatacaatttcttgtgaactcaaaaattgctagttctcatgtacttcggatgaaagtgaaattagcatgctcaggaaaattgtgggaggaattgtaccaatgtcagtttcctggttttgagtcaggaaaatgactcaaaagtgtccccctgttatgccagagaaaatcatatagaaaatgcatggaaaaatttgaatgatttactgaaatgcaagaaaagaagccttatatatacattataattctgtatataatttcaaatgtatgtgtaactaaacaacaaacttactatgatcactagatatgaagcaatgttatcaatgtctcacaactgtaaaaatgtacattggttaaaaatttttaaagggtgaagaatcttctagtagagaaaatgatgatcaccatgcatttggggccaccttatttgtggacatacacagctttccacaattatgatagctaacacaggatttttctcttttagattgtgtattgcaaagacttgtaaaaaaaaaaaaaagtcatatcttgaaagatctttacaaatcacgtttttccttttctcccaggtagagcaagagaaggaggggagagtttgatcctcctgaaggaaagattgcccccctaaaaacttggagataaagaaaaataatggagttgtcaaaaagatttcactctccccatggtcctgatagatatttgtcaactcttgtcagaatggcttgtcattctaatgctttgctcttccctgaaaaacaagaagctaccagcacgaaggcagaagagcaatgactaagacagaatctgcacattcctaaatcattatgcaggagggtgatatgccaagataaatcagggttgaatgggaaagagctaatgtttggtgaggaaatatttattatgggtcactattgcatcatttcagaataatgaggcaaggacagggagaggggataagtaaattcatgtgatggaaaatgaaattttaaaaacatatttacaattcatggaaggccaaaatattttaagtcctgggacagttagaaacttccttatttcacacaatgcctttgaaaaccaataagaacaacaacaaaaaaatcaaggggtccacaaaacaatttttagacagaagtgttgtttatttgatagtactaaacaaatataaattgagcatcctgagagcatatttgcatagcctattgttaggctactctttggtgatatccagaaaaaagttctttctggtattgattacatgaaactggcaccttcctataggacaaccaatcacaaggtgtgaaagtgatgtaaaatctttttgacgcacctgcaaggttcaccgtgggtgtttgtggaaactccttgtcaaaactctgttttacatgctattagtatacatagtcaaacacaacactgaaagaatcatgggtggcccagatctaggagacacatctgacagtagggagcttgggacttcaaaaagtcaaaagactagattgataggaggcagtgcttaatgcatagtaggcagtccataaatacttgttgaatgaatgaagtagactagatggaggtctaggagtgggccacttaaggtcatagatacatatgaaaccaagtatgcagggactcaactggcttctggggattggaaaaattccaggggtctttccactcactccagagagggggaagaagactagctcagcaaaaacaatgatgcaattaatctatgactagtactaaggggtggagttttccaatataagcattttatctcttggattaaaaacactgaatgggctgggcacagtggctcacgcctgtaattccaacactttgggaggccaaggcaggtggattgcaaggtcaggagatcgagaccagcctggccaatatggtaaaatcccatctctactaaaaatacaaaaattagctgggtgtggtggcacgtgcctgtaatcccagctactcaggaggctgaggcagaagaatcgcttaaacccgggaggtagaggttgcagtgagccaagattgcgccactgcactccagcctgggcaacagagtgagactccatctcaaaacaacaacaacaacaaacacacacacacacacacaaaaaccactcagtggtttcccgcttttcgtagaagaaagtccaactctttactatgattgtgcttggtcaacttctccctgaagcagatcttgaggatggggagaggtgataagtaaattcatgtgatggaaaatgaaattttaaaaacatatttacaatccatggaaggtcagcatattttaagtcctgagacagttagaaactaccttatttcacacaatgcctctgaaaaccagtaagaacacaaaagcatcattgagtccacaaaataatttttagacaaaggtgttgtaaattcgacagtacaaaacaaatataaattgagcatcctgatggtatatttgcatagcctagtgttaggctaccatttggtgatatccagagaaaagttccttctccttttggttatgtgaaactggtaacttcctataggacaggtaggaaagactttggtgcatgtgattgatgaaggaagtgcttccaagagatctggttagagaaggagaaggtaaggaagaatgtgacttcaggccatgttctaccctcagcctgaccccagagggagcggtggagcataaattgcacctgagtttgttctgcctcaagacaaggaaactagggacttgtgctccccaccagcaggttaactgctatgggatattccagggggtgccaactcagttctcaggataggtgaggtggttccaatagacccagagcgatcttctgtagaaggtcacatgtgccagccattagcagcaaagctggcggaggtatgcacagagctattaaaagggattggaggagatttggaaggggcaaaatatatgtctgctacaacagtcatttacaagcctacatgatgttgttccaccaagctctctatcctctgtccccaaggtcttatattagccaaggttctccagaaaagcagaaccagtaagttacgtctatctttctttctttctttttctttctttctttccttctttctttctttcattctttctttcttttctttctttccttcctttcttctttctttctctctctctctcctctctctctctctctttctttctttcttgtgggagatttacaataaggaactggcacacatgattataaaggttgagaagttccacaatctgccactgggaagctagagaccccagagagctggtggtgtaagttccagttcaggcacaggagaagacagatatcgcagctcaaaaacaggcagagagagagaattctttttcttcctttttgtcctattcaggcctccaactgattggatagggcccatccacaatgggcagggctttatctaatttactcagtctaccaattgcaatgttaatctcatccagaaacaccttcatagacatagaatatctagctacatatctgggtaccccatggcacagtcaaggtcacacataaaattaaccttcacactctcattagtttctgcactcaagccacaaagattctgtgcctggagtatgaatgcatagattgagctcgctcaagacaaaagaaggtaatgctagccaggagagtttagatgctgaattctgaaaataacgtcataaaaaggctacagtgacctcattccaaagaagttagtttttgattctttgtttatttgtttatttacttttttcttcagtgagtcttgtcctttaaagcacaggctacagactggctttttattttactgagctccagaagtcagaggaaaagatagaggcctttttcctgcaacatgaattctccaaagagcttatcttgcccccaagggggtgaaaattggctcttttggggacagggtgaaaaacaatcttattctttttatgtataaagcacagatatacatacagcgcattaacagatacacccagtgtatctctggttttaaaaatttcatggggaggccaggcacagtggctcatgcctctaatcctagcactttgggaggctgaggtgggtggattgcccgagctcaggagtttgagaccagcctgggcaacacgatgaaaccccgtctctactaaaacacatacacacacacacacacacacacacacacacacacacacaaattaaccgggcatggtggcacatgcctgtagtcccagcaactagggaggctgaggcatgagaattgcttgagtctgggaggcagaggttgcagtgagccaggattgggccattgtactccagcctgggtagcaaagtgagactctctcaaaaaaaaaaacttttttttctcattgggggatgattaggaataaatgtttaaattgactctgggagaagggaaacaataataatgatttgaagaaattaagaaagacaattctaaaaccataggtatctaaagctaaaaggaagcacctcctttatctaagaccttccaacgggcacctcaaggacccggatgctccaaacttcctgaagttcacacagggatttggtgagagagcctggcatagaccaggattttttctgtcctagaccaatgcacattccacgtgtttcatgcaaaacttcatgtatctgtgagcagggtccaagtctgtgcatctcattaacccacatccccacaaaggtgacgctttggaaaggaagtaaattatctacgtggtcaaattacacacctttgtaatccttcagaagagatatgttgtcttgctctctgaatggtgagacaaggaacagtcagagcagagagagaatacctagagagctgcaacatcggggcaaaaatgtatcaggaatcagaagcaacgcagagctcagagaagtgggagagaattagtgcagcgtaggaaattagccttcttcctgactcctcatacactcttcatgtctaaagttgacttcttctattgctgcttttttttttttttttttttttttttgagacggagtctcgttctgtcgcccgggctggagtgcagtggcgcaatcttggctcactgcaagctccgcctcctgggttcacgccattctcctgcctcagcctccctagtagctgggactacaggcgcccgccactgcgccctgctaattttttttatttttattttatagtagagacggggtttcaccgtgttagccaggatggtcttgatctcctgacctcatgatccgccgcctcggcctcccaaagtgctgggattacaggcctgagccaccgcctgtaatttgctgcttaaaatccatccagaagctgagggggtagggggtgaaaacatggaaaaagataaatgaaaatctagtgaatgataatgaaggttttatttatcatccaataaatcattgtcattagactcacctatgtgagtctagttttacaattctctgactgttccctgtctcaccactcagagagcaagataacatatctcttctgaaggatcccaaaagtgtgtaatttgaccacattgatcatttacttcctttccaaagtgtcacctctgtgggggatgtaggttaatgagatgcggagacttggactctgctcacaggtacatgaatttttgcgtgaaacacatggaatgtgcatgggtttagggttgaaaaaatcctggtcaatgccaggctctctcaccaaatccctgtgtgaactttaggcagtttgagcctctgggtccttgaggtgccatggaaagatcttaggtaaaggaggtgcttatttttcactttagatacctatggttttagaactatctttcttaaagacaagctcacctatgtgagttagctttaccattctccccagcgtctgtttcattcatgcatttatttgttcaagcatttattgagcacctgctatgtgccaggcattgtcctccacgctaacattggtggcaggaaagcactaagatacagtaataaaaatcagatttggtcctaactccaggcaaattttaaatttcacagtggagctaagtaaaataggtagacaagcctacattttaattaaattaccttccgttccatggctggcacgtgacgagcatattttctgactgtgcagggggaaatgggctgtgtcatatgtgcgagttccactctcctctggcaggcttcttaatccatgtttgagggcagtcaggattaaatgaaattatgggaacaaaaaacgaaaaatgcaaaaaaaaaaaagttttaattggcttactctgatcttcctgctgtgattgtatcaacgagttggcagcttgtcagttgcagttgccaggcaactctgagcggtaaggcgaacgtgtcagcctgtgtttcccatcttgtttgagtctcccagtgtctgggactgacgtctggttctacctgaccctccacaggggtctgggatgctccacgcagccccatgaataagcctctgacctgctgctcaaagctgcctcatggggaagtaattgataaaacttcagcccttattcaacaacttagctctctaactgtgaccttgctggaatggccccagggaccctgtctgagtcttcccagcccctcaggtacatcagcagaacaggtgtgaaggcagagacaggagaaacagaatgcctgcatcctcctcccctggtgagctacacatacttggaagccccattctgatgtcgtctttcctattcacactcatcgagcccacagagaatgggctttgcagtcagacctagctgggtccatctgttacatacaagccatgcaactttaaagcatattcttagccccgctgtgcctctgttttctcatctctaaagtggagctgaggtggaaaggtccttgagcctaggcgtttgagaccagcctgggcaacacagcaagatcctgtctctacaaaaaaataaaataaaacaaaaattagctgggtatagtggtgtgcacctgtaatcccagatactggggaggctaaggcaggaggatcacctgagcccaggatttcaagactgaggtgagctatgatcaccctcttcactccagccttggcaacagagtgagatctcatctcaaaacaaaacaaaacaaaacaaatgaaaaaaaataaataaagtggagctaacactacttctatcccagggtgttgatgaagttttactgaataaaaacaaatgtaaaatgcttagttcaatgctagcatatagttaatgctccacattttagcaactgttatccaggcatccatgaagaactttgaggcatttgtagaatcccggagctgaaaaggaagttagctagtgattgctgagtctcctcataccttaagtcaggaatctgagacccagagaatcaagagtgttgtacccaaagccatgtcatggggattgaaactcagggctcagttgccaccacaaaactttgccaggattgggtacaaaaaagaatcctcctgtattaaacatatcttgcaggcaatgggtaatagtatttgtgttgagtaatcagagaggcattcaacggacacagctacccagaagacagcctgtttggtctgagaaagtatcatgtgcttcagacagggccgtgtctcacagaagatgtctggttatttccctgctggctgagagaagatgatccacccactttaccatggcatccaagatgtttcttgacctggctatggctcccactgccgtccaattcccctcctccccattcatcttcctgttgatcctcagacgtgccagggagggtcctgcctcagggcctttgcatgagctgttccccttgtttcgaacacagatatccatacggctccctccttcacgtgcttcaagttgttgctcaaagatcatgccctcatggaggcctttcatgagtttcttatttaatactgccaccctctcaagcactttctctcctctttccctgattttccttaaaggacttgtcaccacctgcctcactgcctatgtgtttgcttgtcggtcatgcctgattgtagaggcaggccccacctttacactctaagctccatgagggcacagattttttgcatttggttcattgccgtattcccagtgcctagaactgcacctggcacacattaggtgctcaataaacatttctggaatacatagaaacctctctctgtgaggtttcctctgccctgcacctgccccatgttcattgtccttacccctactcacccttcatgaggcagcaacaagcgtaccctcctttgagaagacgtctgtcctcacctcctccaactggaatggagaccttgccatgtgcctccatagaatcctgcacctccttccagaagggcagccatcaaattgttgcaataactaatttgcctggtatcccaccagaagcttggcctgttctacaattagaggggcagtgaaagaaaaagaagtcttcctctgattaacttctctggctggttgtcagagaccaagcttcctgcctcccattccctgccccaatcccaaagcatttccctctagactgagccacttcagggcagggcttcatgtcatccatctttatattcccagcatacagtgcagctcctgacatggcataagggcacagcgctgttgctcaaataacaatagtcagggctcaccttgagccatgaaattggcctataagggctttccaaccttggcacttgagacgtttgaaatgggaattctttgttgtagggggttgtcctgtgccttggaaaatgtttagcagcatcgacctcaacccatatgccgaaaatacacacaccaattttgcaaccaaaacatctgcagacattagcaaatgtcccttgggggccacacttgtcttcagtttactgtgaattaattcattaaatcctcacagcaatgctataagggggtactgttatgaaatctagattacaaataagtgaggctcagagaggttaggcaactcactgaacatcacacagctaggaactggctgaatcaggatatgaactgggcagtctgactccaaagtttaggcaattaacctaatgaattaatgtcaggagtcgggtgaggaatggggatggtgtgtttattacatgcaggcactatttttagtttttaaatggattgcctcatttaattgtgtctagcctttaacacagtcattgttatttctaacattgtacagaggagggaattgaggcacagaaagcacctgccaactggaggcagagcggccagaattcaagcccacgcagtatgactctaaagcttacggtggtgggaggtggggggctgtttccactctgctccaattctgcacaaagtcatgctgccctttactcagctttccctgccaggacagcctggcacagtccctgtgttccctctgaaatagcttcactgctactcactctcagtgggcctgactcccggggcaccgagccctgagggtcacgatgagtgctttcaagttccaaagcggtcttatacacaaagccaaccgcaccgggggaaactgccagaggcttccccagggttgggacttccaaagtgggggcagtctttgtcttcaaccaaaccaggcttcacagaaaagcacgaggagagcccagaggggagatcttaggggtgttttcagaatatcatgaaagtcttctctgacaaaaaaaaaaaagagagaactatgagcaccttccccaatcccctccctttcagtagttaccgaagcagagatggtgtgtgtttcagaggcatctcctgacatgattgccctgatgtttacaataatgatcagatcattttcccacagccatttcatccaatgagcccaaataggattactgagaaattgcaaggtcttgcaggaaatttctcttctgaccttgggcattgttaggatgactcacaggaagcaagatcccctttcattgttagggaggacaattctgcagcctcttctccaaacagggtgatcccaaagtggtaaggaagagacattctgaatggcaatcatttatcacctgtgcacccagacacaaccacccactgtgcccacatgatggggagacatggcgtgtgactgtttctgtgagtctccactgtgaagcaatgtcagcttctcttatgcaataccctcagcttcagcgagatgcagagaaaaaggttatactagagcacaatcagttctccttcaaagacttttttctttttctttttctttttttttttaattttttaagacggagtttcgctcttgttgcccaggctggagtgcaatggtgtgatctcggctcactgcaacctttgcctcctgggttcaagcaattctcctgcctcagcctcctgagtagctgggattacaggtgcacaccaccaagcctggctaatttttgtatttttagtagagatggggtttcaccatgttggccaggctggtctctaactccttacctcaagtgatctgcccgcctcagcctcccaaagtgctgggattacaggtgtgagccaccatgcttggtcttaagacttttcttcttaaaaacacagcttgataagtagatgaggatagtgaagaccatatgagaaaagaaggatgagggcagatttgtactgtcagataccgaaatgcacactttaggtacaataattgtaatgataaatatgtatgggcaagaattggcaaaaggatcaatgaactaacatatatagctccaaaacaaatagtacacattctttctttctatcccttctttcttctacacctgcacgcacatacatgggcacacacatgtacacaataagttcagcactgtaaatcaataggaagaggaagattcatccatcagatcaattaatgtacccttgggaaaacataaatcactctaggtatttcaaacagtagggactttaatacagggaattgattacaaatgtgtagaaaaataagaggagcaaagtagagattgcccagggattaacacctgtaggaagccagtacattctctagagctggatgatgaaaagaggtattatcaagaagtcaagagtttacaatactgctgatgctgtcgccagaagcagaaaaacagtttctacacttttcccatttgtgaatctcatgtgatcgaccccactggtcaccatcgacccatacccagccgccaaggaactctggaaatatagttttcaggttccccgctgtggtgtagagtggaatagacataaggacaggcatagggctgagatttgacagaccatgtttggcaaagaggatttatttgataatgctacagaaggcagtgagctggtaactgagcaaaaacaaacattttcgcttcttgctgtaaagcaaaatcaatcccaagttgtgcaaagggttaaacatacacaccaatattcaaagacagaaaggaaaagaacagcaaaacagaaaaatatgaggaaaatgttatgatttaagggtgaccaataactttctaaatattgaggcaatgaaaaagttatgaaagaaaaaattatatattagaataaaaataatttctaatggtaagagagatgattacgaatcaagtaatctggaaggcagatttacaatatatattaaaatgagcttaaaacccaatgtattaccaaataaagatgaaactgtaaacaccagtaattctactggagaaacatgtgcatacaatggaatactatgaagcagggaacaggataaattttagtataaacattaacatgcacgaatcttaataacaattttgggtgaagtaaatcacagaagaatacttatagcactgtgccatttatgtaagttcacaaacatacaagataaacttcgttgcttacagatgcatgaatatgtattaaaactaaaaaatcaagaaaacaatgaccacaaatgtcagaactgtagctacaccagaaggcgggaggaaaatagttaagagagatatccaggagatttctaaggtacagaagtgctctatttccttagctgagtggtacatagattaatatttactaattattatttaaattatacgtacacatatttattttgatatgtgtcaaaataaaactgaaaaacaaaaaatacagacataaagaaaaatttaaaccatgaggtaatttgaatcaataatcaacaatattttggatcaaagaaccgtaaatttaaataatgagatgaaaattgattaataatcaaattaacaaagattctagatctcataattctcattgttagcatgagtgcgatgaaaaatcctattctcttggtgggggtataactcggttaaacattttgggaaagcaatttggcagtgcctatcagaagaatttttaaatgtccatgccttagggaaatggcttgaaattcgaataaagtttttatggctaaaatcatggtcattttagtgtttctataatagtgagaaatttagaaacattatggaagtaagtaaatcatgatagatataatgaaacattacccagcatttaatgatgattacaaagagattgtcattatcacagggaaatgcttatgtcacattatttagtgagaagagcaaactgcaaaactttatacccaatatgatctcatctattaaagaaaaacaagcatactggaagggtattttctttccacacagtcatgttacattgcatttcagcttttagcttggcattattccaagaacattctctcatggcgaggagatgggaggttaggtcatttccaacgaccattcttcatttctctcctgacttacatagtgatagagaaagaggaactaacagttatttcgtgttgtcttgggcaccatgttactcctacatattatccgtgtgagatagaaaatatcactcccatatgaacgttggagaaacggagtgggcttaaggcacctgcttaagagcacacagctagtaaatggcaaggtggtacgtctgattcctaaactgtttctgtaaactcccttccttcccatacggtagaacccctgaggcaagcctctgggatatcacagccttaataacttggctcagaaatcagtctgcctgggctgagatactgcctctacttactagctatgagacttcaggtaaattttatttaatttctctgggcctcagtttctgcatcagtagaatgagaataataatgccttccttataagataagatgcatgtaaaatgcttaggaaagttccaggcactcagtagaagttagccaacattgctgtctctaatagggtctgagtaaataatgacttgtttgaggttatttacactctcacttgcccagagtctcctggggaataccatcagcgatgttctggtccaagacataatttcacagatggggacaccgaagaccagaaaggtgaagtgagtaagccagtccacccagtggtaagtgatcgggggtggtcctgactattactgcatattctttccatcaatgtacagcatttccctgactgtcaccccctgtgaccagatgccaggaggaccagaccacaaccttgaaaaacacagccatctcttcatgcacacactattatttatgtatatattatcatttgctttctcaacaaccctgggaggtgagcaaggtgtttctccttggtcccataaggaactgaggcaggaacctcagagttctttgcacaacatcatggaacctccaagagttttgtgtcttggctgcattagatgaccaaattcagatctgtttcttataggcaggaaagaagttgggctggtgaattttcctgatttctctctctctctctctccctctcttttttttttttttttaacagggtctcactctgtcatccagactggagagcagtggtgtaatcttggctcactgcaacctccgcctcctgggttcaagcgattctcctgcctcggccttccgagtagctgggattacaggtgcctgccaccacacccagctaatttttgtatttttagtagagacgaggtttcaccatgttggccaggctggtctcaaattcctgatctcaagtgatctgcccacctcggcctcccaaagtgctgggattacaggcatgagccactgcgcccagcctgatttctctcttaaaccccatggtactagctgttattcaccaacatctgttattcatcaacatggacagggaagcagcttcctccagctcttcacttgtggggctagcccattaagctctccccagagctcaggtggccaaatatggggactgtgacagaggttaggccagtgggacagaagtgatgccatccttcttcttcccaacatcacccctgctgtctacagccttgaggttacaattcctgccttacttatgcatgatgttagcctgtgatgctttctgatgcctgacagcaaccaaaactcccatgagcttgtggtgggggtataaattgggaaaaaatccttgcaatgtctcctaaggctaagcgtacacctccctatgatctagcagttccactcctaggcatatactcaagtgaaagaagtgtttatgttcatccaaagatattgatgaatgtgtttatgactgctttattaacacaggcaaaattgcaagaaacctaaatgttcaacaataggaaaatggataaataaattaaggcaatatttattcaatagaattttgtgcagcagtaaaaaaaagtgaagtacagcttcatgcaacagtgtggatgaatcttgcaaatataatgatgagaaaaataaggcagaaacaaaagaacacatactgtagaattccatttatataaagttcaagaacaggtaaaaccattctattgtgctagaagttgaatagtgtttactgttgtgggcaaggctctactgattattaagggaggaaaacttctggggtgatagaagtgttctgtttcttgaccttgaatggaggttctatggatgtaacatgtgaaaattcattatgctttacattttaaaaatgtgcactttgctctatgtatatacaatctttaaaaaaacaaatcctgccagctggatcactaaggattcattcaccaagaactcagaataatccctaagcaaaaacccctaagataagcttatcttttaagtcaatcagtggattctgtatataccaagtgaatttttctttctctaagacccaacctagcctgggatacatctctcttctcagaggtgttgctgtcattgtactccctgagctgctgctgtgtgtgtctgtctgcccctcagaccacatgccccaagagcagagactatgcaccattcattgcctttccccagtatgtagcacagcgcctggcttagacatgcagtaactattgatggggtgtatgaaggagtgaatgcacaaaagaatgaatgaacatggcacacacaaatatgatctatgaccacaatctagaaagctcctgcggggctgtgagctgtggaatcattctttaggcagcatgatatgagccagtggttctcaccctggggaaattttgtaccacaggggtcatttggcaatgtccagagttaattttggtgaccacaactggggatgggaggtgatggtattctacctggaataatgctaaatagcctacaatgcacaggaaagcacacctcttacacacacacacacacacacacacacacacacacgagtcatccagctcaaaatgtcagtagtgcaaagattgagaaaaccctgatatagaggaacaggagctaaacgcaggaagaaagccttgagttcaaatgttaattgcctacttattagctgtgtgaccctgggtaagttgcaaaacctctcagatctttctcctttgcactaatagggctgatccctaccttaaaagtagatgagaggattaaatgagctaaactatgtgaagtgcctggctcaaaacaggagcccagtgagacttagagaccttctcccaggagcccaagagactttctcttctccactctgtttctgatcccccttccccagagccataaatgggcaatttttagtaagaaaaacagctgtcaagcattgctgcttcttcctctgcttaagaaactattgaagagcaaggctgcctgtgaagaatgcattttatttgccaggtacatcaatagcccctgttcctaatgaaatgcgttattaatagataaagtcaacatattcagaactcaggcccacgttgcatcccaatgtaatctgccattctccctgccttgcaggtgtcctctaagcctgcctctgaaaaaccgattctgattttccccactttccctcgcttttctctaagccccaacaaacacaatgagttcccaagagatacagagaaacgtcacacacaatactagcactgtgtgcaggtggcagagacatcgtgaagaaagaacccagccttgttctttgcaaatgggaagtagaatttcccgcagggctcaatctaaggcttgctacatttgttccttcctcccctttatgtatttatgagagcggccggcccctaggcaatcctaaggtggatgcttatgggtgctgattacgatgacgttttgctgtccttggtgctgaaaaagtcttcaagtgctaaggattatgcttttccattactcatattggccagggactataaaatgggcattaatatacatgttaacattatttagcaaatgcttagtatagaacatttgggaaacacacagaatgaaaacaacaaaaataattagtatttactgagagcatgctacttttcaggcatcattattgacttcatcttgtgagctatgtattacatattccctatttttcagatgaggaaaactgaggcaagaacagtcccattcacatgaactttcagtgacagccacatcaacaacataagaacacctgggctcctacaaagaccaattgcactaccggctctggctccagtctttcttcatcttctccacaacttggtttgtcttggcccccacaggtacctttccctctcctgaaccatcatctccagtctttctactatgccattttctcactggcacacaaatatgcctcaggatttctcatcttacagagaagacacaagactcttggccatcacatccaaacctcgaataactttctcattcatttcctccttttcaaggagaagttccttgaatgagtggtttttagtccttttttctaggtttacaccttccattttatattatttcctcaaatcaccaccaccccccgaaatggaccaagtcaaaatcaacagtgatcatcccattaacaaatcctatggttgcttctttgagcacttgttttagttcccagcaaatctgacatcaataactactcccttcttcttaaactacttactttttttctctttaccattgtgtcaccacaaaatcctagttttcctcctaacttcatggcccagattctcagtccttttcctggacctttctcttccactccccttaaaatactttgtcccagggctcagttttgggaagccttcacttttccaactctactcctcttccagtgagcaatctcatccattcccatggctttaaaaaccatccatatgttgatgcttgctaagtttttatctccaggttgaggcaattgtatatatctccaggcaatcattcaattgtctctccagtcactacttggatgtcttataatctcaaacatcacaaaattaaaaagtacttttgacgttccccccaaaatcacctcctaccctagtcttccccaactcagaaaatgccacaacttagtttctcaaaccaaaatcctaggaatcatcttttatttcccctcatggttcacaaccaatcctccaatcaagttccacagacttaacctacaaaatataccccaatgtcatccacttctttccatctcccatgccactaccctagcatctccaccctctcttcccaggatttttaggaagcctcgtttttccaatttgagctttgattgagtaggtagtacacatattcaaaaatttaaccatattggccgggaacggtggctcacgcctgtaatcccagcactttgggagtccgtggcaggtggatcacttgaggtcaggagatcgagaccatcctggctaacatggtgaaaccccatctctactaaaaatacaaaaaaaaatagctggatggggtggcatgcacctgtagtcccaactacttgggaggctgaggcaggagaatctcttgaacctgggaggcggaggttgcagtgagctgaggtcgcgccactgcactccagcctgggtgacagagcaagaccctgcctcaaaaaaaaaaaaaaatctaaccacatcaaaatatatacacctccatcccccattgctctggtcccacctttacacttcacaggtaaccaaattttcacttcatttttaaagactccttcaagagtctttatggaaatacaaaatgtccattcctcctgtgtttttacagaattgttaaaacatcacgcattctattctgtttcttgctcctttcactttgccctacatcttggagatcttcccacatagatgttgaagagaacattctctttagttgcttagcattccatcatgtggctgtgacaacatttatttcactggtaatctatcctttgacaattgggttgtttccaatatttttctatttcaaatgatactgcaatgctcttgtatatactattctcatacatgccattatatctgcattataaattaccagaagattatggaatcaaaggaaacatgcaaaaaccacttaactgatttctctgtttccactcttgacttctacattacatttccaagggcatctacagtggtgtttttcaaaatataaatcacattagtctgctccccagctcaaagccctccagtggctttctgctgcatgtatatggatttaaatgcctgattttagtctccaatatctactttttttgcactttacctacttggccactcatcaggctccagcaatttgttatatttctagagcacacctaactctccttgccttgacacttgctcatccctctacctggcacactcttcaaccagatctttacattttccctttctatcaaccagatctttacatttcccccccgccccccatcttcggatcagcttaaatatcacctcctcaggaaggcttccatgatacatcatctgaagccctccaccctcaccctcactgctgattctattccagtatatcattgtgttttattttctttattgctcttcctctttctatcccaagcccttaaaacagtgtctgataacaaatgtttgttgaattagtgacttaacatctcagtaaatttacttccagcatctttccaaaaagatattttttacataggtgagatgaaataatgcaaataattttctttccttttatcatctagtgttatatttaagcatttctccaggaaattaaaacttctttgcaaacattctgttttatgaattcaggacaacttatcatagggagagattacaactttttatttttttatttttttttatttttcatttttaattttttgagacagagtctcgctctatcgcccaggctggagtgcagtggtgcagtctcagctcactgcaagctccgcctcccgggttcaagcgattctcttgcctcagcctcctgagtagctaggactacaggcacacgccaccacgcccagctaatttttgtatttttagtagagatgcagtttcaccatgttggtcaggatggtctggatctcctgacctcaagatgttcccactttggcctcccaaagtgctgggattagaggcatgagccactgcacccagctgattataactattttaatcattcactttgttaggtagataggtttctacaatttttgttatttgaattaacacaacaataagcatatttaagcaaaaatatttgtctataactttgaactggatttactaggttcaaagggtaaaatctgtttcagcaaccagatactttttatcaaatagcttctcagaagattgcaataacttacaaccttctagcagtaaatcacccaatcttcagcagctttcatattttcttcagtatttactaatttcataggtaaagtggttcatttcttaaattgtcccttcttataactaatgaagctgaatatttatttagttcgtctttgactgatttataacaacattatatcaacacccatttccacaggcttacaaagagtttggctgtattaaaacccaagacatcaagtaatatggctgtgaattttctgccatgggaaaaaaagtagtaaaccacctatgggattacagcataagtacaacttgcttttctcttactttgggaaagatgaacctcctttatagtacaattttcaggaaatgcattgcacttcccttgttttccacataggatgtaatttccagcaccactgcaacatcttccaagggaggcatttttaaatcactgacagatattgtgaaggttccatcatggaggttccatatagcgacttttgttttgcattttcctggccatacttctgtttagaacctaccattaactttgataatttaattttacccctttcctaagaataaaatccatgcacatgtcagtatcagcaaaataacatcacttctctcttctatagcttcagctaacctttaagtgaatcttaaaattttctataaccatcttccaaaactaggcattttatccaataatataaaattagcatgttatagagggtgctgcacaaatagcctacactgattcacagatgactttaaaaattcagtgagccaagaatcccacattattgattcatgctaacaaaacgatgaagtacagctaatctttaaaacacatgctgggcagaatgacatttataaatgcagacagaccgaaaccaattggacataattctttacggattaaactgatggctgcaattagacctaagaaggtgagcagtctctctgctgggaactgagactcagcctcctgggtccaactccaattttctctcatccttggctaaacatggtattccactgttccactgaccggctagttgagtagagttccccatgactactcaggttaactaaattggtttgtaaaatatgacatgttaccactttggcttgcctctttgacttttaataacaactgccccgaagggggctatgattaggatcatcatagcatgatgctatcagtgtagaataccagatgagcccagcaaagagcctgtagggacagaatatggatatatccctttgtatctgccctgtccctctccctctccctctctctctccctccccctccctcccgccctcccttcttccttccttccttccttgtctccctccctgtctctctctctctctctcttttgacatagtcttgctctgttgcccaggctggagtgcagtggtgcaatctcagctcactacaacctccacctcccaggttcaagcaattctcctgcctcagcctcctgagtagtgggattacaagcgcctgccaccacaacttgctttttgtatttttagtagagatggggtttcaccatgttggccaggctggtctcaaactccggacctcatgtgatcctcccgtctcggtctcccaaagttctgggattacaggtgtgagccaccacacccagcctaactatgtttttctgtttaaagaaatatctgggcttgactcatagctcccagtcctagggaacaattctgtctgccatttcagagtagtttcaagattaggctgataaacatcacccaaagaacagaaattcttatagtcacccaaacaacagataactcttatagtcttaaaattcataatgattctgcttattagaaaagcttattagaacagtgatagggtgagaaatattttgcagccatgcagtgtgacagaaagcacctacgctgggaaatcaaattctgtccctgtcacttagttacacagtgagggctccatacatgttattatgtcctagtttccccactctacctacaaccagcagggttattttgagactctcttgagatggctcagggaagctcttaaaagagcctaaagcacatagtcttaaaagaactgccatccacatttgatggtctcttggctcgctctctcttcttcatcttctcaccgcattcttttccttctttactctttactatgcgcttaacattttgggaaccagcaagaatacacccaaagagaaactccaggagcggggcaatttcagggacatggaattagcatttctataatcgttaggactctcttgttaaaaatgagtaacaaacaaacaaaaaccttgaattactctgagaaatggaggtaaagttctggtcacatagaacacaagttttgtcccaagggcataaaatctccttgacaggctcaaactcagtttgaaaattcataattattcagtttaacagagggagaagggagactgatggatggaggatgatggcatgtttacttgttgcagcagtggggtagaacacaaattccaacttttcaaataagaccttcatggagtaagtctcttctactaacgggctgtggaatttggggcaactaactgtattagtcctttttcatgctgctgataaagacatatccaaggctgggtaatttatattttaaaaaaaagaggtttaatggaatcacagttccacgtgcctggggaggcctcagaatcatggtggaaggcaaaaggcacatcttacacggcagcaggcaagagagaatgagaaccaagtgaaaggggtttccccttataaaatcatcagattgtgaggctcattcactgccatgagaacaatacgaggaaaaccacctcccatgattcaattatctcccactgggtcccttccacaacatgtcggaattatgggagccacaattcaagatgacatttgggtggggacacagccaaatcacatcactaacctaacctcattgagcctcagttatctcatctgtaaaatggagataaagatgaccatagtaaatagaactaaattcatgactcaaatgatgtcatgaagattcactttcttttttaaaatatcaataattattttatgtggtatacatttaaggggtacaagtgcaattttgttacacacacatattgtctagtagtgaactcttggtttttagcatgtccatcacccaaatactgtacattgtacccatgaggtaattgatcgtcaccctccccacttccactctctcacctttccaagtctccaatgtctattgttccatactctacgtccatgtgtacacattatttagctctcacttacttctgcatcttttaaccctatcttttgccatgcaagctttgttcttaggatcctaggtgctcccagcttctccagccttcccctaggttaaagtccagctaaaatgcaggcgcttcacccaaagtcctgaggctatttgattggcctggggaatgcgggtgctgattgaagcctgagagtccttttccatccagaatcctggagtcaacccttcccaaactgtgtgggatagaaaatggaaatgggctaggcgcgatggctcacgcctgtaatcccagcactttgggaggccgaggtggcgaatcacctgaggtcaggagttcaaaacctgcctggccaacatggcgaaaccccacctctactaaaaatgcaaaaaaaaaaaaaaaaaaaaaattagccaggcttggtgatgggcacctgtaatcccagctactcgggaggctaaggcaggagaactgcttgaacccgggaggtggaagttgcagtgagccgagattatgccattgcactccagcctgggcaacagagcgagattccatctcaaaaaacaaagaaaatggaaatgataaatgtctagagtgatggatatcccaataaccctgatgtcatcattacacactatctgactgtattacaatatcacaaatacctcataaacatgtaaagctatgtacaactattacatattcaaaataattaaaaatgaaaaagaaagtggaagtggtggattcccaaacaaactaggaagctgtaaccagaagatgaaaaaaatgaatgcaccagaggcaaagcacagttgtttgccatgtttgcccagctgaaaatcaacggcaatgttttttgtcagtcattcttaaccctggttgcagattaaaatcacctgggagctaaaaaaaaaaaaaaaaggatggctgctatctgggcttcaacttcagaaaggttaaatcaaactccctgaatgtgggaactggacagtggtggtttaaaagcacccagatgatcctaacattcagccacggttgagaacggtgtctatgtagacttgtgtacacatccagaagggatgtttaggtgggggattttcttctgaaacttctatacaaaattagaattcccatctaagaagttggaaagactgcaaatttagaagacactaggatcttgtcagtgttgctacttctcaagtaattacagaccctcagagtctgaaagattcgggctaacaatgagttacagcctccattcaaaatatgaatcaactccagggcagtctgatgtccagttttttcttgtacgtctctaataattgtgaactcatgactttatggggtaacatagtctattttgttttttgtttttgtcatagctgtgacttcctaagacctacatacgagaattctgacccaaagctctaaaaaatcacctctctctataatcaatatgacttaaaatgtactctttgttatctggcacacatccacagctagttagcaatagagctggaagttgatccaggtttactttgaactacatatacatatatatatatatatatatattttagatggagttttgctcttgttttgttgcccaggctggagtgtaatggcgtgatcttggctctccacaatctctgcgttctgggttcaagcgattctcctgcctcagcctcccaagtagctgggattacaggcatatgccaccacgcccagctaattttgtatttttagcacagatggggcttctccatgttggtcaggctggtcttgaactcccgacctcaggtgatccacccgcctcagcctcccaaagtgctgggattacaggcatgagccattgtgcctggcctaaactacttcaatattacaccatctatagtaaaaaaaaaaaaaaaaaaaatggggaggaaggggtgttaataaaactgaaaaagctggaaaacaaaatgatgtaagtaaacccaaacaaatgtgttatggcaataaatgtaaatcttttaagctcccacttgaaagtcagagactctgagattggatcaaaagttaaattcccaccttatactgtttgcattagctaagcctaaaacaaaatcacatatttgggttaaatgcaaaagaagaggcaaacaggtgccagtccagtacaaacaaaagtcaagccagaggcagcaattgaatgtcaggcactgtagaattcaagcaaaataccttaaaatagaacaacaggattgttttatactgataaatatccaattcacaaggcaaatcaacagtcataaatgtttacttgctgaaatcattaaacacctagagctaaaattactagcaatacaagagacaaatgacataaacacaatcaatggtgtgagattttaacactcaagagtttttgacagattaagtagacaaaaataaataaggatgcagtggatctgcataatataattaatgctgactgaatagatttttaaacattatatcaagaaaataattgaacttcttgtaagagataaactaatacaatttccaaaatatatatcattttaggtcacacacacccaaaacaacaaagtttggtaagtggtagttcaggtcacgttctctgggcatatatagaaaatactaatgtataaggatatataggaaatgtatataaaatggtattctgtgggcatccatattagaaaacacttcaaaatctaaaaagtaaataaatcaaaaacccatccaaaatttcaaaaagctaaaaataatttccagatctttcaaattgaaaatctgtctcctaaataacatggtagtcaaagagaaaattaaaatattggttatagattacttagaaattaatgatctgagaaaaacaatatacaaaaatgtgataatccacaatttcagcctttattaaacaagaaaaaatgaaattcactgaggaaagcacagcaatgaattttcttcaaagggagcaagtaaaaactaagaaaagcataaggaataaataaagggcggattttaaaatcccaataattagaaaagcaaataatctgtatagttaatatataaatctaaatggtgttttgtttgtaaacagaaatattaacaatttagaagttagaataatagctaatgtttattgagcacttagtatgtgcctcacagtgattaagtatgttattaacaataccacaggctgggcgtagtggctctcacctgtaatcccagcactttgggaggctgaggcgggaggatcacttgaggtcaggaatttgagactagcctggttaacacagggagatcccgtgtctacaaaaaatttaaaacattagccagatgtggtggtgtacatctgtaatcccagctactcaggagggtgaggcaggagaatcccttgagctaggaggtagaggatacagtgagccatgatcaggcccctgcactccagcctgggtgactgagcaagaccctgtttccaaataaactaacaaacaaacaaacaaggagggccctattattgtcttgattttacaagtaaagaaattgaggaagacagagaggaccacaatgggcccaagagcacccaagcggtgagtaacagaatgacctaagctcctaaccaacactttatataacctctcaatatgaagaatgagggtaaaagccagaaattagtaattacaaggtaattgaatatatatactaaacatataatttcatgctaaataactctgaaaatcttaaggatatttatggctttcttaaaaaataaattataaatattgactcagttggaatttgagtatatcaaaagtttaggagaaattgaataagtcatataaaaatcatctctgaaggaagtactaggcctaaattattctaaatgttcaatatttcaaaatttggaaaaataaataattcccatgctaggtaacaatttaggaagaaaaaaaatgtgtcctgatttctctaatgaggttggcatgagtctgttgctgcgacctaacaaaatccaaagaaggaagaagctctgatccaatcttacatattgatatagctataaacacactagataaaatacaagcaaacctaattcggctatgcttttgaaggataattcaccacaaccaagtagattttattccaagaaaccaaggatgatttaatactagaaataatttagtattcagaaatctattcacatcatttatcacaccaatgggtcaaaggagaaacatcatagtcaaatagtacaaggtctttgacaaaatgcaataccatctcttatttagtctttaaaatgcagaaatcttggaatagaggagtatttcgctaacattgtaaagaatagttctcatgtatcaacagctgacactttactgaactgtaaaataccagaaatgctcctgttaaagtcatggacaaaacagaggtcttgcttttcaacagttttagatactgaagaagacaaggaggaaaactaaactttagtttaccaccagcttggaagcacaggcattgccatttgacctgggcttggattttggctgcctccctctccagtagttgagccctattttggtaaatcagtaagtcagtttcttctgcatgaggaatggtaaaaggacagtgaggattaaataagcagacacaggctgggcacggtggctcacgcctgtaatcccagcactttgggaggccgaggtgggcggatcacgaggtcaggagatcaagaccatcctggcttacatggtgaaaccccatctctattaaaaatacaaaaaattagccgggcgtggtggtgggtgcctgtagtcccagctactcaggaggctgaggcaggagaatggcgtgaacccgggaggcggaggttgcagtgaacagagttcgcgtcactgcactccagcctgggcgacagagcgagactccatcccaaaaataaaaaataaaaaataaaaataaaaataaaaataaaaataagcagacacagagagaccccttggcacaatgcctgatgcagggcagcgtctgaattcacaactgcttccaggctcagaaatatcagttgtttctttactagaaaacatggtaaggtcaactgataaatgattagaagtacccaagagtttaataaaatatccagaggccatctaaatacatacaaatagcagtgaaaattggttagaagttagaagtgtctcaacaggcctcttgctgacaattggattttgtagactgttgtctttactgcaaggccctccccatcccattgttgcctcatccccaaccagccattatcttataattattgtttaggtttcaaatcattcatcactccttgtggaagctttttctgacccccaagccaaaccccctaccaagtgtacttttaactggatcatcttctttgacacacttgccatagcagaagttttatatttttgtagaattattggattaatatttgttttctactcaaggcttaagttctgagtacactatgcagctattaaaattatgtttatgtaaaagaatttaatgtctacatatgaatttatttttcaatgcatcatataaatcagtatataagcactcaatcttcatttctaaaaattacacattagtatatgcataaaagataaaaagatactcatcaatatattaacagtaatactagatttttattatttaaattttctttctcatattcattaatgcttttaaatatttaacataaacaaacagtatttcttctttaaatgatagggatttgccaaatatctaaatttttaaaacacttaaaatagatacttttcaatttttttttaacatcaggtgacaggtgtttaggtggctggtcattgatgctgaccacatataaatatatatatatatattacctagaattgtcttctttcaaaaatttatctttctgactggtaaaatgttattcctaccgaagagagcaaagaattgagcacattaaaaaagaatcagcaatgatggtaaaatctggagaaatattttactctcattaatataagaacaagcccatatctcagcccccacacaattaaacatctagcaccccttcacttacacacacacacacacacacacacacgacaatagcaattggtcaccaaatgcacactgagcatctactacgtagctcagcccagagctagctgttcagagggcttagtccctgcccttgatgaggtcattggccaccgagaccaacacattgagaaaagaaaaccaacagcacaaaatggaatctgaacactgacaaacaagtgttagacagtagttttgcacattttcagagttacaccttcccacccatcacgggctgccagcagaactcccggtggtggtgtgaatcaactctatttccatcgtagcagtataaatagaggaatgacttgaggaactccccgtgctaaccaaatacattcaaacacctttattggggtctgttcttttgccaccccctagctggggtgttgtcttctagtctgcaaccacagagcagtgcacctgccaaaacttcttcaaatggtcttcttccatttggggcatctgattctgctctctcctctcccacaggaagcctgggtcaaatgcccatcctcctttttctcacagtctcctaaggtccttttgttactgttcttgacaccctatattctactttcttcttgccctctctgattcaccgaccagaccaaagctcttcgtagtcattttttatgtatctcagtaggtccaattcctagctctgtgttctagacatactttgtgcttggcaaatatataccactttcaatcaatgaagaatgaataaatgaaattcatctctggacacctttacaaccttgcattccttgcctttgcttaagctgttccatgcatctgagatgcccttttctcaactcatttccatatgttcaaatcctaacctccatccttaaagttctagaatgaatgccttctactccaggaaaactcccctggcctctcggccatcagtgacttccccctcttccaactactacagttctttatcaatttcccacattctacccagacttagtgttattcatggacatatttttacatgcccctccccattaattgatatactctgtgatgtcagagactatgtgtctcctctatcctggtcctcctcccagtgaccacattatagacaataaattaataatagacttattatggacacatgcaggattagtgccttggagatgtcagccctttgttcatttcttccatggctggatttggcaaatttgaacagaaggagatatggtaaagacaagctcttggatcttattaggaactcaaatatttccattcctgccattttttatgggatgtgttttaacttggcctaccaggaaatgtgtgtgatttactataagtatccgaatgaacttaaagtgtcaggagaaacatgagaccatcatctgagtggggggggagggtagaaattgatgaatgaaattcttcctggaaatacattcttccaggagggggatgcaatgacatctccaccttgtctcatcaaagcatacttctgaagagagaagacttggtggacacaggtcaggagagctggctgaccttgctctcctctaatttttgagctttcccaaacacactatttttcttctcctgcctgggcttgatcttggcggctcatgcagcaataaggggagttattttggggagacagttgatgcttggcgagtcctcctacagatcagcaatagctgtttgaaatgttaaatgcctcccagatggagatacttagcatttgtaggaggaataatttggaggagaaaaatgcatttgtctttttggcatcctgtggattgcgttacagaagacagagaacactgtgaatcctgccatccacatgtcagtgttttcctggaattttgctagtcccaggtgactgtgctgctgctgctgctgcttctggggacatcaaggtttggatatgccaatgctcaagggaaaagtatatgggactgagtctcagaggtcagagagcttccagagtgcccaggaaccatcagggcttagcctcccggctaccattggcaaatgcttcaatcatgtagaccagatggtttttacttttgggtgtggtcttttatacacagggaggctgaaaaatgtagtgcagactagcagagagaaccagggattgagaggcatgagttctggccttgcttttgccactaactttctttgtggcttcaggcaaaccaccttgtctcacaaagcctgtttccccacctttgaggtgaaaagattggattagatcatctttaaattcttccctaactaaagaacaatgctatggtacttgttgtcatggcttatgaagaaggtgacattatggcagaagggtaactttgagttttccttcaatatgagcttccaggtgctaaggaagagaagacttcattcaattgttcatcatgccccattattcatggcaaggatagagtgggtcattcacaaaaaatactgaatcaatgacccttttatttatttcttggcacccatgagagctctgtggcccatcagtaagcttcatcaaaaagttatgcctttgagtaagcagccacttttagcaccagagtgaatttgagctggatagaaagctcagttctgaaaaattgtaactggataattgtagtgtaagtgttctcacaccacactgagatgtgcaaagaaaagtgtgcctcctttatcttctatgctagcctcacacacattttagaaatcccctcatcccctcaggtaggtgggtgggtggatcaggggtgctacatttagttaaatccagtcagctttgtcctatgcaatgatgaaaataatctctataggaaattcatgctcttttggataatgctgtctttccaatttctctcttctcctcctgatcattcctgagatagattctgggtactggggagagcggaagaaggcagccttgggttcttacatgttttaggctcccctgtgccctgcagcaatgcactgtgcccctctggtcattggtcattttatcaggatctgatggaaaagctggggctgctaacttatgggctattttcctactttgtctggacacagattctgacttgacctcacaatggctgtttggagggctggacatacctgattccagtgtgccctgctctgggaaccatataacatagccctcagttgcagagtaatgtatcccaccctggtaaaccccctagatggaatctcagctacctttctcctcttccatcatgaggcatgggtaaatagtttgattcattctaccatacaagattttagtgtcacttgggaataataatgcaacccctttccctctctacccttctctttctctgcatctccgtatctctaactttgtgtttctcttccctccattgttatgctactatcactttgctatggaagtctcaatgttggttgaagcagcttgggaggtgtctatttcccgaatctcaacctacatccaaggcttgagcctcagaagagataggaaggacccatgcacacctcccagcatgagagcatcctcttttccttatctcaatccattctgagccagaaaaacacgtgatttccactttttcctatcctgtgatggttttgcctatattttatcctcctgttttctgaggtaaatttcttttcctcttgcttttcctggggaaaatggtacaatggttgcctggaaatgcaatgtttgtggtataagataaaaacaaataaataatattttaaaatattatttccattacaaaatcatttcttaaattgctgaaagagatttgcttgactgaggttgatacactttcttctctgtgagccttccacctataaaacaacatggttagacctcacattcattaaaatcctttccagttcttgtgtcttagtctcacttaacaatgagatgctataagaggctcacaatgctctccagataattttccaaatgagtcattctattcccaaaccagttagagtatatttgtttggcatcttaccaataaaaaaaaaaaattgagcttatcaatcttttgcccagctaaaccctactatgagtcctgagacttaatcatttactactaagtagctacggatacagtttatccaacaagactagaaaccacagaataacccatgaagaatccagttaacacaggaagtgactttcaagtcagaaaaaggaggagaagcaaaccaaaatggcagctgacaagaggaattaagttctcctctaactggctaaagcttgagactggtggcttctcataaggtgaaatgggaaagcccagattccagacatatcaacacagaggtcctggtatatcctattgtaacaaggaattaactaaaatggagcagggaaacttcctggcggattccaagattctgaaagtgaaaaggctgaaacatgatatctacacacaaagtgctctaaggaaaagaatccaggggcagtggttgaaggcttgatgattgatctccaagttgaagttgtctcagttgctctaacatatgcacataatctcccccactttatacacaatccatacattgtctaggattttgtttgtttgtttgttttttgagatggagtctcactctgttgcccaggctggagtgcagtggcaccatcttaactcactgcaacttccgcctcccatgttcaaacgattctcccccctcagcctcccaagtagctgggattacaggcactggccaccacgtccggctaatttttgtatttttagtggagacggggtttcaccatattggcaaggctggtaggatttttttaaacaaaaaaaaattgtagtaattatgaatggcacattttagctattctaagtagggatgagaaagtgaactctgccattcagaaaaatagaataaaaacatctttctgggaggatgtattgttgaattgttatgttccattctttttgcctatcaggaaatatttattatggctgctgtatgtagtgtgccaggcacaatgggatactgtattatgcagcacaggttcagtccctaaccttgctgctaaaaatcaagtagaagaggtgagaaaataaaccaaacattccactaactgtactaagtgctaacataggcgatgtagataggtgtctggattcggatttctatggaagctctaacttatccagtggtgaggaaggtgagaagtcaagaaagtttccaagaggaaataaatttcaatggacagaactagtaatcccaattggcctccataaagacactttccagcaaaaggagataatagcctcccacatttggattcccagatttcagccccaatggcacttgagttgtcagactcaaagaagtaagacatagtgtgttttcctcaacctctctccacctcctacttgagcccattcctaatctatcggtctctacttataaatatctactaaacttccagcagctctgcatggctgcctttaatgttgacacagagaacaagagggtgatgtttcttggagcttcccaaactacaaaaaacctgctaacacttgaaaaccacaaccctgacaaacacatcatagtctgggagttccagcactgagccaattttatgcatgcatttatttgtttgtctaaagggaaggactttcttcaaccactaaaagagttcctcaaaattccctagttcccaatgcaggcagacatgaataatgtatttaaggctgctttttttttcattccttgtcttccagcagccctcaggggctgccatattgagtttcagcactcacaatcctggtcgcaaggaagaacatgcctagaatcatgcattgagtggccaaacgcaccccagggcctccagttttatccccttaacaagggacttgaagagtctgctgaacaaccagctgacgctaactgacctcacaggaggctcataacaggaatgttatctgtcaggaactggttttcttaaaactgattttacctagcaagcaaagaatcactcatttttaaaaaaagggaacatcctgaggttgtaagaaagacagttatggcttcagattcagctcttggatttgcttgctatgtgatattgggtaagtcacttaacctttccgagcctcagtttactcatctgttcaatgggaaacattgctttcttgtaagcgtattattttaaaaataagtcttatatttgccaaaacaatgtgtacacattgctttattaaaaaatcaaagagtgttgaaagtcttaataaaagtcttttaataaaaaaaaaaaattcaactctcatcacccctgaatcttactccctggggtagctgctcccaactcctctggctgattattttaatattctacagatttaaatactgcagatttctccattcttagatccctccaccacctttttttttttttttttttttttttttttttttttttttaggttgcttgtttgggtctctctcttctgcattggaaatcctccccatggtctggtcagcttgaagatcaggactctaagaagccatttgtgagttccatgcacatggggtctggactgttgactgatgaaattccttgtaggatgatgaggcagtgagtcagcctattcattgggagctaccatatttcaggatcttgacgtcttttctcagggatatgtcagtttctccagataaaaatcctctaaacatttggatgagaagagagaagggctgaaaggctcaagtcttgactcatttctcttcccactgtctactgtctctgttgaccccttaagtcctgagtctttttggtttattacccacagaaatcccatttctgtgtggtgggggtgagaggagagaagggaggtagttgtctgactgtgtcaggggagggataggcccctgggagccacgagctctgcacacgttgctagatcccacctgctctcatcttgcgtatacctgggtgccttaacatgcctggaatctaactctttattctgtgacgtcacttgtcactacttctctcctttccactttcctctctccccttcttgctttattcctttctttcttcccttctccctcacttccttcccttgctcctttcttcctttcttcctgctaccttttcaatggagggaaatgagataaactcaacatgactctcagcttttcaccccttactttataaacagaagttctgttggaaggcctaattgagaggaaggatgaggaatctcttgctgaacatctggcataatatttatatgctcagttacacttatttctgcatcatgcctctcagcatcaccttggacattccctgacatgcccaaaggaaagaacgtgtggcctgagacataagatttttaggaaattcctagagctcagggtgcatcctccaagagagggtgggagggagggagggctctgaaatgccctctttctccaggtcagtcaattaattcaattaatcctcaagacaacttcattaggcagttgctatgatgatcatttccattttatgcccttggtcttcatatctatgcactgtattaccatggcctaggacagtcactcatttggggaagaaaaaggtgagaaatagcccttgaccttctgcctgtcaacagagtttaaaaaatacaaccatctttccctgtggaagccttcccaccagaacctacacatacatagaattatcctagcgtgatctcagacacagacacacacacacgcctgcgtgctccagaaagtggtaactaataagtgaaaccaaggttccgaggtctcctggtgcctgagctcccctgcagggctcccaatcaatacaaggtttgctgtctgcaacttggctgatttactaagattacaaatgaaaaccagcccccagagggtgcagcgttgctgtagcacagaaggaaagcgtaattcttgcttacactcggctttgtgatcggtttctcccctggtagctagtcttgtaacttctttttagagatgtcaatcttataaaaaacacacacacacagccccagacttctgcagatcaagactttctcatctcactggggtgttctctccccgctaaccacaggatactctgtttctctgtggctgtttcaaatggaacagctcttttggtagtttaaaaaatgtatattgaatagtgataataataactatcattattattgtgcttattgttatcatttctagttcctgtgtctaattctgtgtcagatgttgtgcaagacaccatgtagccaatatctctacaccttccccaacccacacagtttatgtataagtatcatttcctgacaaataaggaaactggggctcagagatggtaaacaacatcctcaaggtcacacagccagttaagagggattcaaacccagttaccctattgactgtggtagctctagaaccttcattcctaacactaagaaaggatttcaaatacagggtgactgccttaaaaaccaggctgtcggccggttgcggtggctcatacctgcaatctcatcactttgggaggccgaggcaggcagatcacgaggtcaggagttggagaccatcctgaccaacatggtgaaaccctgtctctactaaaaatacaaaaattagctgggcgtggtggcgggtgcctgtaatcccaactactccagagactgaggcaggagaattgcttgaacctgggaagtggaggctgcggtgaaccgagatgaggccatcacactccagcctgggcaacaactctatctcaaaaaaaaaaaaaaaccacaaacacacacacacacacacacacacacaaaaaaacaaacaaacaaaaaaaaaaaaccaggctgtctttctgggttctgttgatgaatctgcctcagagacaatacctggattccaacatattcctcggtttctggatccatcatcttcatagctaaaagaaaaaaaaaagccaactgccttcctcctgggaaatttacatctcttaaaagggtaacaaatatctcacattttccatctataatatgagccattgtcagagttctccttccatgggtccactttatgctccaatgacctcatagctccccagatgtacaatgtagggggcaagaaagcctggctctctccttaaactaaggttcgttagaagatccaaaaataaaacttttaggccagctcaggaggtgaggactaggctatcttgtcccccgccccactagagggaacacactggtgatctactttgaaaatcaggcaactggctcctgtaagtggcaggttttgtaagacatgcctcagcaaatccatctaattcatctgagaatgctcttagcttcaagtaatggaatggccaacaaatacgtccctccttcctcataaccagaaggctgctgaccttagttcagtggtctaatggcctgaggccagcatctctgtgattctcatggctttctcctcatggtctgctctcgttccaggcatcatgtccagaacctgggtaacataaaacaggaaatacatatgtgtgtgcctgtgtggatgtgtgtgataatatatagagtgatgaattcagggagtataccagatatagctgtccttttttgtttaaccaagaaaccaaaaacttctggaaacctctcccagcaaactgttatcatattcttggccatatctatgtcatataactactcttagctcccaagaaatctgggaaatcaggagttatagttaggtacatttctaccctgaataaaatgggatttttttaataaaaaagaagagtaaatcaatgtcaggtaaacatcctctgaatgatcagtgcaaatctgtttgggcaccctgaattccagttgtctccaagcatctcaggtgctccataaggacttcttcctatcaggataaacccccaattttccctcaggagttctcaaatatcaataatggtgaaggatagctgaggtacgcatgaattattcatcaaggtttttactctttgatttttctataggagttgatatacaatgtatctttgttaataactagaatctgatttgtgcatctgatggtttaaatattctgccttaggacataccaatcacccagcatgtaaatggagttcagccatatcctagtgggattagaggtagagaaacagccacatctcaaggagcccctcacatacatgttgattctaattcagtgtctgcctttcactctttgtccgcctggacccgtgtaacaggtctgctggaaatccttcatcccaaatactcagccagtgttgaacccagaactcttgctaaagtaaacaaggaaaatatggaaggggattttttaaataatcttggcatccaacaggctggggttggaatcttggctctgttgcttaattactttttgacactagtcagtttatctgacctctcaagacctcagtttccccaaatgagcagtaagaacatcaatatttacttcaaagagtgattttccaagttagataacatttttaacatatctagcatggtccctggcacatgatagacattaacgaaacattattcctattagcatccttttaagaaagcagagttgaaatataattgaaatgccaggggttcagtctaggtcctgctgctcatagcacagagagctaatcactgagacgatgagtattgccagggaagaaggctttatttgagtgctgcagccaaggaaacaggagattagtctcaaatccatcttcccaaccaggtaaaatagggctttatatagcagggaagaaatgtggggaaaataggaattagggaggagctagaaagaggtcaataggaagcaggtggtcattaggcactcatgacaggtgaggggtgtggcatcttattgtccagatgtggtgatctggtgagtttccgttccttgatactatctgggaagcctgatggtcagtttcctgagaaagaaactcagttaagataaatgtaagtttcaagctttaagactgtgagggacagacaaggtggctcacgcctgtaatctaaacaatttgggaggccgaggtgggtggatcacctgaggtcaggagtttgagaccagactgaccaacatggagaaacctcatctttactaaaaacacagtattagccagatgtggtggtgcatgcctgtataatcctagctactcgggaggctgaggcaggagaatcgcttgaacctgagaggcggaggttgcagtgagccaagatcatgccattgtactccagtctggggaacaagagcaaaactccatctcaaaaaaaattttaaaaataaaaaataaaaataaacaaaacaaaacaaaaaagattgtgagggtcaatttctatgtttattcaagaaaaaccaataacataaattctgcgggaccattgggctggtttcagtctctgctttctatttatcagttccttaattatggggaatctggtcattgatctttctgtctgctttatgctgagaaggggtgatgagaatttagaaggggctaagagccgacctactgacttacttctgggggctatttgtatgttcagcagggcaagaggcaagaccttttcccaggtaagatttgtctcttggcaaattttagaaagaagtttacaaaactgcttatgactcaaaggaatttcctttgccatttaagagatcacactctagcctgggagtcccagcttccaaggctccgaagctgagctgcatcttcagcactggcctaaatgggtgatctcttttgaagatctgtgtaaggacacctacaaccaccaaaaaataacattataactaatcttagcccttaaaaatcagtccttacattctgatgtgcccacctcttctgcaattgtctctaggcctggagggattgaatagtttttatttctggccctgtgtctcatgaaatcagttcattttgacggtcaccttctcctggtctgaaaatggggctttgattggtatcaatgttcaagatttagcagtagtcagtgcctttttcaggagtcaaagtcctgtaacttaatggcccaaggactttaaaagcaacacagaggccgggtgcaggggctcatgcctataatcccagcactttgggaggccaaggcaggtagatcacttgaggtcaggagttcgagagaagcctggtcaatatggcaaaatcccatctctgtcaaaaatacaaaaattagctgggcatggtggcacgtgcctgtggtcccagctactcgggaggctgaggcacaaaaactgcttgaactcaggagacaggttgcagtgagccaagatcacaccactgcactccagcccgggtgacagagcaagactctgtctcagaaaaaaaaaaaaaaaaaagaagtaatttagaaagttacatggatacaaaaccttaaatcttagtttttttaagcaatttgaaaaaaacaaaactaagaatgatgacataggaattatctaggtaaaacataaaaactggcctaaccagttaccaaaaggcaaagaaagaccttctgcagtgtgattgcttctccttatgaaaagcctacttagataacctgaaagtcaaatccaatgaacactttagacatatcaagaaaatccaaatgtacagaatcaaattatactgggggaaaacattatggttctagaccctcaagataaacatttcagcgtcaggcagttagacagcagcaggtagaaccagaggtaaaaagttacagtagctgacaaaaaagttgaaggagaaagttatcatctcagtccttttcaagtggaggaaaaaattgaaagccactagtaagacataatgaaattacacttctgaggtgggaatgtgagaagttttcaaaaagaaacagattatagaatcaaaatcaaaatctcttgtcaaatcagtctcttgtcaaatccccttgttctaacatagaggaccaatcttaactttttcatatctctctcctctatgtactggttcctttctaccttgtttataaataacctttctaagtccatgattttaatgaaactttaggtaacttctgaattttcgacaaaactattcttttttctcaataagagcacatcttctttggcacattttacagacagaattattatctattaactagagttcttattcttagtaaccttgaattccagtaaaaacctgaaaaacaaaaaaattctgaactatcagatattagcattttctagatgagaacatatcacaatttttaaaaacatattttcccatatcataaccctttcttaatcaatcagaaatgcctcccaacccatgagcatcattttttttttttaattttaagttctgggatacatgtgctgaaagtacagttttgttacatgggtatacatgtgccatggtggtttgctgcacctatcaacccgtcatctagattttaagccccacatgcattaagtatttgtcttaatgctctccctccccttttcccccacccccgacaggctccggtgtgtgatgttcccctccctgtgtccatgtgttctcattgctcaactcccacttatgagtgagaacatgtggtgttggttttctgttcctgtgttagtttgctgagaatgatggtttccagcttcatccatgttcctgcaaaggacatgaactcattcttttttatggctgcatagtattccatagtgtatatgtgccacattttctttgtccagtctatcactgatatttgctggaatgtgtgaagccattcctgctgtctggtacccacggaagacattcactcatccacacccagatgtcaaatttcaaaggctcttcttccttagcgattagtaacacagttggagcaggcagtggtggagccaaagagagagactaaaacccacctctgaccaaaaatggtcaagcagctgcttagaagtgcttccaaaacacttctagcccctgcagctgagccacaaacaacacgttcccagttgggcaaccaaaatctgttaccaaaatgccaggagtaccatctaggttctgttgctcaccgtacagaaagtcaattactgagacaacagatattgccaaggaagaaggctttaattgggtgctacagccaagaaataagaggtaagtctcaaatccatctccccaaccaactaaaattacaggtttatatagcagggaagaaatgtaactacatgtgggaaaataggaattagggagtggtaaggaagagaagctggttaacaggcagcaggggttcggttaggaaaacaagaattggggaggggtaaaaaagcaatcattggctgggtgaggtggctcatgtctgtaatcccagcactttgggaggccaaggcaggcagattacttgaggccaggagttcaagatcaccttggccaacatggtgaaaacccgtctctactacaaatacaaaaattagccagatgttgtgcctcagctactcaggaggctgaggcacgagaattgcttgaacctaggaggcagagattgcagtgagctaagatcacgccactgtactccagcctgggaaacataactagactctgtctcaaaaaaaaaaaaaaaaaaaaaaaaagaaagcaatcatgatgaagagtctagcatctcattgtccatatatagtgatctggtaagcctcagttccttgatactatctgtgagggatgacagctggtttcctgagaaacgaactcagataggacaaatgtaagtttcaagctttaagactgggagggtcaatgtccatgtttatatattaaaaaaaaaactataacatcaattctctaagacaaattggtcaggtttcagagggagattaagacattgaactctatttttttctttttcttttttatagaaaatctggcaaacccaagactcaaatttcagggaaataaaaaggtcttcggaattcactataactcaagttcaaatcccttctcttccatttggtagctgtggtaaccttggctaatttatttaaactctttgagtttctgtctctttgtatgtaaaacagggggaaataatacctgccttatttagttgactattcattccacaaacacacacaagtgcctactatgtgatagacacagggatacaaatattaacaagacagacatagttttttgttttttttttttctttgcttttgaaatttaaagtctagtggatgaatgttcggagtaactttaagcacttccaatttacagaaagtctactaggtgccggatcctttatttcgatattcacagcttccctaaaggtatgtggaacatcatccatttcacaggtgaagaaactgagtttggagaatttaaagaaatcacccaagagcacacaatgaatggccatgtcaaaatttgcactggggaccacgggacaacaaagcctttgataatgctgatctggatgaagcactgggcacaataatgggtgcatggaaaacgcaatctaattaaatgtgcttcagagaattgatactgcattatcactggaatctttggctaaacttgctaaactttggcaagtttagccaaagactccaacaatatcatgacaatagcactcacctcctcctgccttacagacataggtgcacacagagatttgctttcatcggtcttacagatgagttgcagaatagtcatgtaacagaatcaggcattatgtaatagcagaacaaacacaaatagcccatgagaccagcagcttggcataaattactaggagccatgaaaggcacagctgtatctaaagcatatgattacacagatgcacccatacacagagaacctatcaggaatgcatgatgactgtctttagagttccttaaattaggcacacaagaaaaatgagtctacaccctgccaagacaatgaatgatggtaataataacaattacatttattgaacaattaatatatatcagacatgttgctaagcaatttacattcattgcctcagtttcactttcaataatcctttgggttggatactataattatttgtattttacagttgaagaaactgaggctcagctgtccaagtgatacatttgataattgacagagctggggtttaaaagaaggtccacctgagcactatacttttaatgatatgtcattacaagcttgagcttcacttttatgtgtgaggacagacaagcctcaatattccccaaacctgtcatcattcaattcccatctccctactatgcatcttttgctcagttcttttctctgtctctgtcatcaatggacatatccccgaaaaagagcaacattcctgtaatgtgacccttgatcacgtgttcccaaaacatcttcaaactgtgcctggccttgtccacatctctacacctttgaagtcattcccttacagaggaatcagaggcatagagggcttctaaagacaagacaagacaagacaaaacaaaaaacagaaaaaacccaccttggttcaaatctaggcttcccttctccctgctatgtaaattggagcaagtcacttaacctctctgagccctagtgtctttatctgtacaatgaggatactagtacatatttcctaggaactctcattagaaataagtgaaaaattttatgcatgaaaatttgaaagatatggatgtgcctaacacacaataagcaaaataactgctattttccttctcttagttttgtatggagaacacatacttatctttgaaaactcagatcaaagcctcctccttttctcacacgtgggttttgtcactccatcctctgtgctctgggaactctgtgtctctaatcagcactttttacattgatttttatctgtttaccagactatctttactattagaaagcgagctcctccagggaaaaggctttgtcttatttctctgtgtatccacagagtctactgctgtcctaccactgtgtagaataaaccatcgtttgtcaattgctgcattaaattgcattaacactcacccataaaaccacctggagggggtgtgtcttggagagcagagctcactgttcttttgcttgtgttttgtgtattgtctcacatccagcataacaacatacagtaaatctgagagaaaccaagaataattgagcaatatagcttccttcttttgagcttctaccctatgctatgcactagctgttttacgtatatcatctctaattctcatagtgatcttgcaaggtcattgtgacttgaataagaggatgagatattaaattatgtttacagtcagtctcctccctactccctgcctgtaaaagggaaaagatcttggtccagctcatgagatcttccttactagaaagtataagccaatttgactgggccacggggtacccagacattcggtcaaagattattctgggtgtgcctgtgaggatgtttgtgaaggagattgatatttgagttggtggattgagtgaagtatctgccctctctagggtatacaggcttcatccaatccactgaagacttaaatagaaccaagaaactgaccctcttttaagtagaagggaactcctcttgcctggctgtttagagctgaaacactggccttttccggtcttcaggctcaagtggaaacatcagctcttcttgggtctcaagcctgccagctttcaggctacagtttataccatgggctctcctggatctccagtttgctgactacagaccataggacttgacagtctccaaaatcacatgagccaagtccttatagtggatacataggtaggtaggtaggtagatagagagacatagagacagatgacagagaggcagacagatggatagaaacacacacacacacacacacacacacacacacacacacacacacacacacctgtttctttttctctggagaatgctgactaatacaagcagaatccaaatagtgctaaaatggaggtgaaaatgaagaaatagaaatgtatttgatctatacgtaacaattttaaaaatgcaaaagcaggaagaaaagtgggaaaacagaagagcctaccagattatatatgaagcagcatttgggggcagtacagagaaagaggcgagagtttgcaaggaagcattcctaagaatgtaagagactggaagcagggaaatagagaaacttttcaagagatacataggacatcagaaatgattctttcctttgtcattttctcaagagtttgaagaaagctttgatttgtttttaacattttctgatgaaaatgagacattatataagacagggccacatagggtcctagttatgtgcagattacagttatacagattctcatacataagttacatgtgggttacagttatagagattctcatgtataagttcaacatttggggtgggttattggtttatgaaaatctctctctctctttccctctttccccttccctcctcatttctgtctccatctctctttctccctccctcctccccgatataaccaatttatttagctaaggatacagaaacctattgaatgcgaggtggccatataaaacaaaggccactgcaatgtgtctcattttagcttcccttggcccccagtgtctctgaaaggtacacatttacataaatgcaacaaatttagagagtcacatttttaccagtattcttgatttttgcttttttaattaatttttttaatttttgatttttgtatactcaaggtatgcattagaattgcacaaagactttcgctgacaagctatgtatttctatttaaaataagttctcctggttctcaaacccatattcggtattcacaagacccatgttcttaacagatgtaatgggggaaaaagcacgttccattcttaagtcagttcttagatgtccctgaaaaaaatatctgcccctagcactccagaaaactcatttccctgccaacaaagcttgcaacgttattattaaccatcaagatgttatcaaaatgccaggggttcagtctaggtcctgctacttgccacacagatagccaatcaatgagataacaagtattaccagggaagaaggctttaactgggtgctgcagctgaggagatgggtgatcagtctcaaatccatgtccccagctgaccagaagtgggggtttatatagcagggaaggaatgtagctacgtataagaaaacaggaattaggaattaagtagcggtaaggaagaggagtttgtcaacaggaagcaggtggttgattaggaaaacagaaattagggaggggtaaggaagcaatcatgatgaatgaagtgtttggcctctcattgtccagatacagtgatctgttaattttcaattccttgatactatctgggagacctgatggtcagtttcctgagaaaggaactcagataagataaatgtaaatttttcaagttttaagactagagggtcaatttttatagttattcgaaaaactgtaaacattagttctatgggatgattgggccagtttcaaagataacttaacttataaatatcagagacaaaatatgaatccggatctatctgactctaaagttcatgattttatactcttatctctgcagagcgagttcttagaaaataggcatcaaattatgccaatacaacttctatagaagagtgagtctgcaagccagttcagcactcaggagtttttttgtgccgtaaacagccacggccctcctctaagggctccaaacggagcacctggtatacctgtatggctagtccctagggcagtcagatcttttgaaatatggacctaatttaagcttggtcttttatcaaataactcacccgacaaattctcagttggcaaccaggaggcatgatatgagcttcggaaatttattatgaagaaaacaatagatcaggtaattcactgtctttggaggtttcatgtcagaggtttttcatcccaaattttactttattttgctctgaatagaagcaggcaattaaagatgtccagtcaaatttgtttttgagataaaaaagtgctaaggcagtatgggaatgttccaaagcactccaaatgtcaaataggaatggtcataaaaaggcaagttgaatgttaaagataagttgctgcaattggaatgccataaaatatgatagcctctttcaaaattttaacattcagacgggattagaacagcacagagcccttgagattttttccaacatcctcatctccagatctttcaaattgttgaaactaatgcacaacccagggcctgagaccaaatttctcaactctcaggccagtgaactcattcattaacttggaaagtaagagctaaatatttatgatggatgacttcatttctacccttatgtcaaatttcactgacaccactaaatatttcagaacacatgctcatcagaaaacttcccagcaccacgcacagggaagagtttaggaagggtcacaatatctaggcatattgtctacatctatgttttacctagagtgtgttcactgatgggacagagttaagtaacattgcatacttgcattgcatttcatttccttcttgaagattctcgattctcctcagctaattaaaagttcttagaagttcacctataaagagaatatttagcattctctaagtcattcaccctagtgatctggtagtactttacaaactaatcctgtcaaaacaactcctgaacccctccaaattcccaagcctatatctaaatttcttttttttttctgataaaaataaaattctttggcacctagaatataacattatttcctccatcccagataacaggatgctgctgggtcaaagtgggtgagcttcatagtttcattcttgcaagagaactggtcttgtaaatgcatatggggttagggagagcattgcattccaaggagtttcaactgttttttgaagcgaagaatgcagaactagtggggggaactaagaaaatgcaaatatagggttagaagtagaggaataaaggagtttctgaatatgtgcttagcattctgcatgattgactggatcaaagtttctcagatgccaatgtgcatcgaaatcacatggaggttttattaacacagagtttggggccccactcccagggttttcaactagaaaggtttgtgtggggcccaggaatatgcacttctaacaactttccaggttatgctgatgctgctgattcaggggccacactttaagaaccgctcttctagaccattggttagccttaaatatctggcataactactcagaccagcagtcttcaggtttcttcttagcataaaatctttttgtgcatgacatcattgttgttgtccgggtggtcttccgtcctcacccgacatccatggctacaccaggaaaccactcctcccacactgtcttggtgggaaactcagtcaagttatttccactctcacctggacagagtggatacctgacaaaagccatggaggggcccagctataatctaataccagcagtgagtatgggggtgggagtaagaagaagaggtgaggtagagatttcattgttgctagaaaatgagcaccaaaaaataagctatgataattggctccttttccatgcatctcaaggtcccattttttttcagcagctttcaatacagtctcatcacagacatcaatatattacttaattttaaaacgcattattttaagaatgagcccacttacccaacccagtcatacttctaagccaatcagactcctatgcctgggaatttgaattcctaaacaaattcctaacacaaagtccctaaaccactggagcccaaccctggcaccatgaaattttggtctattagttgctgctacgtggatccaggtgctgtccccagtcctatcttccagtattgtccagcttcccctttacttctctgtgtctcctcatttctctttactaagttcctttttcgcctaagtaagctaatctgtttctgtggcttaaacctaagattctcccaacaaaagaaataaggaactccatatttaacgcataaaaatagtatctctgaataaagaggggagtggggacctatgactgagacaactggaacctgtcacacgtgctcttccttcccaaagaacacctccaatgagtttctaaatagcctaaaagttttgggagacacaaatgggagatcttggcttataacatctacttgtgttttgggctcactttggcaaccagctaaagataagggtttgggtggatctggtcatcttaaaggccagtggataaaaatatagcccacttccctgcgagttttaattataaatccttgtattagctcattcccaaaaggccttggaaaagtgtatttgtgtataacacgatcctccggcacaccgggttgtattactcatttcatcagcatagatggaatccgatatttggctccactatcataacatacatccaagggcttatttcctccaaaagaagtacaattggaaatagcatcgattgagccaaaacatgttaatttcagcatatatcgttaaagagcaggcatcagcaaagatgcagcgttgaggaggcccacacaacagaaccatgagagtccttacaacacagccccaaatagaagctgcctcctggaggtctcaaacaagaaaagaaatccacatgaataagctttgtcttaaaaaaagagttttccatcctacaactttctttaaaggatagctcaactgaaagaagtcactgtctttggaaaacaaagccccttcaccaaatttagtacaattttacttctagagatggatgcttcatgatagagcataagggccccaggaaatccaaatcccacaagttgaggggcaaactgttctattcaggagactagacgttctgactttgagagtgctagacaagcctgttctctgtgatcattttgaataggaccctccgctcaaagggtgcggggtggggtcttagtctgattgctacatcagtccaatcaagaagctgggaggccaggcacggtgactcatacttttaatcccagaactttgggaggctgaggcaggcagatcactcgaagtcaggagttcaagaccagcctggctaacatggtgaaaccccgcctctaataataacacaaaaattagctgagcatggtggcaaatgcctgtaatcccagctactcgggaggctgaggcaggagaatcgcttgaaccagggagttggaggttgcagtgaactgagatcacacaactgcactccaccctgagcgacagagtgagactgtgtctcaaaagcaaaaaacgaagaagaagaagaaagatgaaaaaagaaagaagaagaagaagttggaacatagaccctctgaaggctaaccacttcatttacagagggaggactccaaaggccatatgaagtccacttagagatcagaatctcagaactagaaggccagataagtctatctgagagatacagccattaaacagagaaagagctagacaagctcatgaagggactcagatactcagggggcttatcagtcttttctaggaatggggagctgagaccaactggagaagttcaattatggttcaaaagaaaatattctctgctgaaaagttctcagctagggtcattaatctaagaaggaaagttaaggctgaaaggaattattaagcatgcattgcatgcttatttctagatgggaaaaccatttccagcccaggctgaagacaaaaacagaagacgatatttgagtcatattgagaagaagagtaggaatatggatacccaagaagtttgacaccctaagaaaaaaagacactgaactacccacctttgtcagcataacaccactgcttcttctgactttatcttagcctttgtccactcaattctcaaataatcactgaacatacgtatcccgagatgcccccacattttcctataaactgccctttttgcttagccttggtttctgttgcttacagccaaaaacctttaacagacacaatttcaagatcctaaaaataatcccctagctttcattatctcatcctcttcctcgttgctttaaaatgcctacaaacatgtgcagctccatttgaagaaataaaaattctctaattgcatttttgcacccagacatctgcatggtatttcacagttcgcacagtattttcatagcttcactaattggtgatccttaaatacttgtgaggttaaaaataaggaggtttgttggtgtcattatctcaattttacagataaaacagaaagtctgtgagattaattagcttgttccaggatctcatggctcacgtgctgtgcaaccatatttagagcaaggtgtatctgagtttgctccaagagtcctagattcgccattcttctttggaacctcttactttggtgtctcaaaaccttaattttccccccaacattgtatatccaggaatccaactaactggattctggcccatgaaagtacttggacttgagttgtgtgtgatcttaaataagttattatttctgttctgaattagattctgaacatatttttttaagaagcttcacagaacagactttttgttgttgcctttttttttttttttttgagatgaagtctcgctatgtcgcccaggctggagtgcaatggcgtgatctcagctcactgcaacctctgcctcccgggttcaagtggttctcctgcctcagcctcccgagtagctgggattataggtgctcaccaccacacccggctaatttttgtacttttagtagagacagggcttcaccatgttggacaggctgatctcgaactcctgacctcaggtgatccactcgcctcagcctcccagagtgctgggattacaggcgtgagccaccatgcctggccacagaacaggttttttatgcagtccaaacacaattatatgcaaggattcgtactgcacaacaaagcagtccacaatggaaggtcattcattgaccaccatccctccaatgggccaagtagattgagttttcataaaaggacatgctcactgcttaaatgtccattttttgtgcatcctttcccttaaaagagcaaagtgaaagattctgatattcctgatgtggcttagagaattcttaatcaaattctctaacccagatctgtactggacgtactctcaagaccatcttcctccttgagtaagaataaaacttaatacctggagtcacttaggtttgaaggatgagcaaatgtcattataaaaatgttatctacagaaggtaatgagtgcatggaaccatggtcggcttatcttcattgaattaacacattaacaaattcaaaaaagattcttagagaatgggacataggatacacaagctttgatggaaactaggtaaaagaatactgtctgtgttttactccctgagagagaggagaattccttacaatggaattccttacactggaccattgattaaaacccatgtatgtctagtgttccattactggaacgctaagcatgtgggagttatttatatcctactgctcaaggtcatcgctgaggtctgatttctcacacgtctgcaattcaaaaaaattgcaatctctggcataaatgggttaaacatatctgacacctaaatactgacagtcactcattatcggtgtggttatgggtgagttcctgagtttcttccattccaaaaaggaaataaaaatcttgcttcacctgcatctcaaggcttttgtggggacctgggaagacagagtaaccacgaggtcccagaaagatttattgggcacaaagtaagagaagtcagagataaagaagaaaacaaatttctcattcaagatggtatactggggaaaacactggaccattgatataaaaatactgaaagtcattcattatcagtatggttatgggtgagtcccttagtttcttccattgaaaaaaggaaataaaaattctgcttctcctgcatctcaaagcttttgtggggacctggtgagctaatggaagagggaatgctttgaaaagaattgtgattatttggatgtagaaggcaagatgcaggaggtgtcactgggtgacccccaagttcctgacttgacaaaacaggtagataagaaaagataccctggaagaaaaacacatttgagaagagagtttggtgggagttgagtatcctgtgttagtggaatacccaaatggagatgtacaataggcagctggatattcagaacacttgggccaggtgttctccagaactggtccaataaccagaaattccatccttctctcagctggagttactctgactgtgacagctgctgctccagttactctatttattgttactaatcccccagggccgcaagacccttccacagaactctctctcattcctttccacataaatcagcagaagaactacactaagtcccaggtgataaatgaaccccttccccaaagagtttggcttaagcccaaatcagcagcttgcctgtcgatttattgttcatttaaatcattcttgcctcttatgacaaaatgttaatgacaaaatataggtgatcctccaatggagggaaaagctgtatctttgcaactggaaattagaaatgtattattaacaatgagcattaattatatattttaatgctcacaggagagatgtgattgggggataatttgcagagaggcatagggggctctgaaacctagcgcgatcattttattagacagatcctattttctgcaaccatgaatatttcattcggaatatttactccatcttattattcagccattcttcctcggctaagccccagatttagacaagtcttctctctttcctgatcttgttcttgagagaccgacagttatccagagatgatgtatgattctgagaaagagtatcctgaaaaccaaattataatttgctctgtccccaggaaaatccgtattagcaatggaggccctgtgattacttagggctgtgcacactctatgggaaaaggatatgaggtatcttaagtgttgatatctcttgctctggaaagtcttcctaatcctaataatctaattctccagtccaagaccagatccagagtgcattgtcctgccccatcaaagacccccactaggttgtcctaattacctgtgaccaagacacacatccctctgcaaatgtgccaagcctagatttcaagaagtattcagctcatcagaactgaacattttaacaaatattcagatacataaacacccacaacctacacccttgcaaatatgatcaacttcatgggagtagatgtacttgcccagcatgcaagtaagtttacccctacttcaatgtatttcattaaatgaagtatctttccaccttttactgagtattatcttattccttcctcacaacctcacagcaacatactcttcattctgtgtactttgggtagaagtcaactgagcttcagagagaacatagaagcttaagaaataaactcttagctgggcacaggggctcctgcctataatcccaggactttgggaggctgaggcagatggatcacctgaggtcaggagttcaagaccagcctggccaatatggtgaaaccctgtctctactaaaaatacaaaaattagcagggtgtggtggcacacacctgtaatcccagctactcgggaggctgaggctgaggcagggagaatcgcttgaactcgggaggcatagattgcagtgagcctagattacgccttccagcctgggtgacagagtgagactctgtctcaaaataaataaataaataaataaataaataaataaataaataaaatgagcccttaagggcacatgctggtacatgctagaactgagtttaaactaaagaccaattctgaagtttatgtatgtaagatcatccaacccaccattgggtgaatttgagaaagttcaagaaaaaaaaacaaataaaaaataatgataaccctaattgtaaacaacagcaagtgccatttatttatgacatattaaaagctttgcacacattatttcatttagttctcccaacaatcatatcaagtaggtacagttatctgccttattttattgatgaaaaaagaatctcagaaggttaagcaacttgaccaggcacacacagcttctaagtgtgggatcagaagtcacatctctctgactccaaagcaggcaaattttcaccttggcattgaagcagttttacagacctatgttgacttttcttttcaccaattgaccagggaacttctaactactcagcattaaacttcctaaattattccattcctcctctgtcagactacgagctcaaagccttagtcctggaatccagttttctgccccaggctccctgggcctatgggtccagaggagctacctcttctccagtccaaaagagttccctgacttcggagtccagttctgtctgggtaaaacactctgctgaagaagggtccataagggattttactatggctatctttttggacatattaaggggcaagttctctaatgactcataaaggccattaacatgggttttgcagtgagtactaagaccttcccatatgagtataactgaaaccctacacaaataatgtaatgtttaattgcatgtgcaaataaaattgtgcaaaactctctaagagtataaagttcgaaagactgtattttataaagaattttttaatgatataggaacaaccttaggcaagtatgttaaggaaaaaacagcagggtgtgaaactgtacatagtgtatcatcatcattatgtaaattatctaaaagcgagaggtgggagcaggggaagtacttgcagataaatacacaaaagtgctaacaatggttgctgatagatggtatgatggagacttttaattttctttttttatatactgcgaaattttccaaattctcctcggcgaaaatatttgtctttggcctagggggaaataaacatttatgaacaacaacatgttaggttataatattcaaatttacatagaggtctaatattgtagatttgatagcaaacttcgtgaaaggagaataaagctttcaggttttgcttctgtatctattcaccccattagacgacattttgttgacataatattttctgtttgttcctttccttcaccgctgatgcagttagaatatctgtgttaaacaagcctacctgaggccaattacagctctccttccaaccctagaagacaggagaagagaagcatctcatttctctctcaccccatctgatacatatattcaggctgggcgcagatgacatctgtccagacaacggataatattgcaatcacttctgattagtttcctgttaccaccacgctgttcacctgtgttacaggagtggctactggggtgtgctggaaggagggaagagtaggcgatgaaggcagttactgtaatttgagaatctgtgctattgttaccaaagccgtttcttcagaatccagatccatgcatcctcctttcctcacatacagacattctgcatgtgggatatgctaggcaaccagtcaaatttcctatgtttcagtgggatggactgtttgtcttaatttacattgctccaggaccttaggagccatcatattggtgaagaataaataggtctcagcgattgtaacatgatgcatataatttgccactgacagtttttcccctgaaaatagcaatgaggaaaaaaacctagttacttctttcaagccagtggtgaactttctattcgttttctgagcaactcagttttttgagagtcactcttaattttgtattaataaaaacttgatttaaaaaatcaggaagatgtgttatgaaggctgtcaatccattttctaatgatccacatttcctttttcaaggccaaagctataactttaatattaaaatacatgttcactctaggccttaccaatgttgattaagccagggataaggcaagaagcagaaaagatcgacagtatattttcattcactctctcttaaaataatgatgcatgcaacttcatgtcattactttttaatgatcttagcctagttaatagcacagtaatattccaaaaaggagcaggaaattatttccacatttaattttcattgcaaaagtgagaggaactcttgatttttttttctgccagagaagctgtctgctgcctatgactgcattagctctgctacattacagctgagctaatggatcaaagccaagtgattactttcctagtcttttgagcatttccaagtaccaactgactggctctcaaagacttggacatggcttttcaatgtcgccatgaagtttgcttgatttcccatcaaggcagggccttttgaccttgcaactgacctgagatgggattcattatatgtgtccctttggatatcttggttgcacagaataattagaaaagggggctctaggaagtgtaatagaatattatacattatgatcctaggcctttggtatggagcagttaacatcacagagatggttccttatgttggagctcatggcagcaagatttaagatattacattttctcaattccataatgttcttcattataggaaacacaattgatatattgtatatatcaattcttctttttgggggaaaggagaaaaataaaaaacaacaaactaacttaaatcttgacataaattgtaaaatgcatctgagataacatcaaatgtgaaaaaaaataaaagtatgtctttgaaccacaataagaggccaccatatatccaacagaatggctaaaattaaaaagactgacaacaccaaacattggcaaggacacagagcaaacgtaattcacatacattgctgatggcagggtaaaattggccgaccactctggaaaaagttctgacagtttctcataaaatgaaacccacaactatcctatgactcagcagttccaatcttaggtacttatccaagagaaatgaaagcatgtgttcacagaagacttgtacctaaggaaaagttgtcagtagcaactatattcataataaccaaaggctaaaacagttgtgcatcaactgaggaacaataaacaaactgcaacatcttcattcaatgaagcacctttttttttttttttttttttgagacggagtcttgctctgtcacctaggctggagtgcagtggcacgatctcagctcactgcaatctccggcttctgagttcaagtgattatcctgcctcagcctcccaggtagctaggattataggagcttgccacaatgtccagctaattttttatttttagtagagatggggtttcaccgtgttggccaggctgctctcggactcctgatctcaggtgatccacctgcctcggcccgccaaagtgctgggattacaggcgtgagccactgtgcctggcctaatgaagcactattctgtaagctaaaggaacaaactactgacagacacagcatatagatggatctcagagacattatgctaagtgaaagaattcaaacacaagagtgcatattgtatgattccatttatagaaaactacaacaggcaaaactaacctctggtggaaaaaaagaacagttgttggttctggaggacaaaggatcagggcttgacaaggaagggtttcaaggaaactttagttaataacatacatgttgatgcctgcaacttactttgaaatacgtcaaaaatataagctggacggatggatggatggatgagtggatggatggagatagatgggtggatatgtgataaaacaagtacagtaaaatataattatagaaactagatggttggtatataggtgttcactgtaaaagtcaacctttctgcatggtgataattatgataataaagtgctgggaaagtatatctttgaatcaagtaagtatggtagatgaaatgtttcacccacatccttccctgtccccgttgtatggacttaaagaatccgtaatccctatggtgtgccttctgaaagctcacgattcttctatcttgttccattcaaaaatctgaaaaatcagcatgtgaacttgttccggttttatagtaggtagatgtgcgtgaccaatctcactttgggatatttgtattttaatccaataatgcatttaacactcactaagggttttgtttgtttggttggttggttttgttttttgagatggagtcttgctgtgtcacccaggctggagtgcagtggtgccatctcggctcactgcaacctctgcctcccaggttcaagtgattcttctgcctcagcctcctgagtagctaggactacaggtgcccgccaccatgcctggataacttttgtatttttagtggagatggggttttactatgttggccaggctggtctcaaactcctgaccttgtgatccatccaccttggcctcccaaagtgctgggattacaggcgtgagccactgtgcccagcattaagtatttttttttaagagacagggtctcactatgttgcccaggctagggtacagtggctattcagaggcaccatcatagcatactacagtcttgaactcctagacttaactcatgctcccacctccgcctcctgagtagctggggaagtgtctatttaattcctccagtgccttatctatttcctcacctttaaatatagtaacaaccatgttttgtgcaacttctgtgtgccagatactacgctaagtactttcataaattattgttattattgtaaactgtcttgcggtttaggagtcattaccactgctttacagatgagaaaactaaggtccaggcagtttggaaaattttcctaaggttagacagctattctgtggcaaagtcagcattcaaaatctggtgtgtctgattttgaagcccatgtccttcaacatacaataaaatgaggacttggactacggtcctttttggttctaaaatctctaattctgggagaggaggaaaatcactgtattagacactgttgagagcaatcattaaatttaagggtcttcgtataattttatgtcaataaataaatgaatatataccaaccgatttatagcattacctccagcgactcctgcaggctggttagtttcttgttcccccaacatcccttgtgtttttaaacataacaaaatgcaaagagaaaagacaatcagagatcagtctggaaaagagcacactgctgtcaccagctacctaacatcaactgattgctatagctcagggttgaatttgttgtttcctggaagccacagtgaagggcaaacatcttgtattctatagcatttgctttcatatacaagatagcatacaaatactactgcaggggtgaactttttttctttcttggacaacttggtaggaatctacattcttattcaaaaaatgttagttaacagggaacagtatctttggctttctttttttaaaacagaaatataagaaagcattcttcaaatggacaaaccttctgggatactccctaaaggcagcatatgcccttaaatagaaactcggctaaggccctgctgtgtggccgagaattagtttcacatgcttggttttgtgagaatctcataaaatattgatttagaacttggagactcaagataaatgactaagttaactggtcttttggttagatattgggctgcaattgattcatgactggtttctctaacataaattcatgggacagaaattgagttttgggttatagttcatacatttcttcctttgccattaaatgttgtgcatgttttcacctaaatgatcaattacattgtaacagtaaccccttattttatacagcattatgtagttatcaaagacctgtaactcttttgataacttctgtctctctctttctctctccaaactccctcatctctgtaggatagatactatgccctcctattttattttatagattagtaaatagaagaaaagagataatagtcactattatttcattttacagacaagaaagttgaaggaaagaaatctggcaaaaattacatacttgatagttgcggcagccaggactgaccctgccttacctctgtttgaacagcaatagcaataacgatagtcataaaacatcacagcttttatgtagcaagatgctttgcatgcatacgtcagtgattctccagtccactaagagattggaagactccctagctgagcaggtccctctgctggaggattcagggaaccaaagcctatcccaaattggctgccatcttgacaatttctccccatcgcccactgccatcatggcagcacgcactaaaccagagaagcttctacatggattggttaaattctgggcttcctaaaatgttccagaggctgcttgcaatggggaagtcacagaggagtaactgagcctatcattcttggccaagtcctgcaattatggctcacaattatttaggctcacctctttctgatatctgcttggtccttccttatttaagatgcacaggtggggtttccagatggtctgggggacactcattctttatttatcctcttcgtttgccttataagtaaaggaaacttgagattataataaatgctcaataaacattatacccgttctgggttatcagaaaaacaatgctaatatgccccatattagggtttatgagctgtagacatgttctcaccaaaaccaaatgagacctggttcactgtaatgctcccatccagcaaaagccaccacacacacccgagctccctaatccagcttggagagtctcccaactggctacaaactaatcagaaaatataatgactttgtacgtaatcaaacagtacaagaacacttcttttgttgaatggcacataattccacagacttccatgtgctcatatatgaccgagggctaaatatctacaggctaccaaaggtgtaattaaggataatagacactggtactcatgaactaaaatcactgcattcctaaagattactgaagattctaattcaatgtttttcaaagaatgattggactatgcaggatcccttatgctccttctcaaatgcagtttaggagtctgtagtgctgagagggtcatgctcaaaaatatttaagataccacaaatgagccaaacaaaaaaaaagaacaaaataggatgttgagactgaccatccgaagcttcaccttgcccattatcacatgacctgcttctctcctcctgagctctttattttctgattgttaccaactaacctttctagtagacaggtaaaaataatacccttccaaagatgttgcagtatagttcttggtctctttaccggagtgttgttaattacacattaaccacatgaagacttgggatggaggagggaggagttcttgcagcctgtggaaggggagcctacagcacatcaattaccaaccttaaggactgttcattaagtgagatgatttatataaaacaactatcacataataaatgctcaataaacattatacccattcagtacctcttcctggggaatataatccattttctacctgctgattaattagcgagagtcctgcatatctgagtgatgcgccatacagagcatggacagttgattcatcatgaataatgtaatgtcacaatctggactatttatattcaggtgaattgtacataatatgccatacatgctaaagaggaacattaatatttagcattccaagctaagccaggatgattaatttggttttaacttagtatcttctttgcagaattttcaatcctctttctctttttaaagggacattataagaaatattttctacaacataattggttcttgcttatacactgcttaaaagagttgtgtgggatgtttcgagagccttaaaaaatctccagctagctttttatccagatgttttagttctgagactttatgctaaggagacatttgaaagtatatgaggaaaaagactatgcaagaatgtataagaacaggtaattgcttcagtaaattcattcattatatggaacattatgcagtcattaaaaaatgacttacacaaagcattatcaacaacacaggaaaaggaatatacttaggttatagatttcagtaaaaataattagcatacagtaaggaactgaagaaaatacagcaaaatgtttacagtggtcatttttgaagaagtgagtctactgataataccttttgctacttcaaaaaaatttccccatttgcttttttaattggaaaaattcctttacatgtaagttaaatattactggctccaagctccatgaggccagagtctttgttcctcattcactattatggttccaagtcttaacatagggcttgtagtaatttttatcaaccttattttctgcaataataatttctctgtttttttttaaaatttttgctgagttcctgaagccaaggaaattaatgatgtggaagagagggataatggtcaccagtcaccatttattgaccacctactatgtgcccgcccctgtgctatcctctctacacatgttatttctaatccttgtcacagccttgtaagtaaatatgatctgtatgtttcagatatggaaacagaggcacacagagaaagctaaggaacttctccaagttctacttagtatgaataaaactcaactgtgtgattctagtgttttcactgtttctactagagctcacctggcctttagatctttctagaattccataagcagatgctgtctcaacacaaagataatgaccttttcagttttcattgcagatgttcctgagtgattactgcttctattggtttacacacggcatgcgtctatgcatttaaaattgtgcacctaatgacccaggatgccttcctatcatccatcctgctctccagctccacttggattcctttactgaagccccagcacttggtcttcttgagtcccttgacctctcagcaaggtgagagtgggtagccatgtgcttgaccgtctgggcacacgaacgcagcaccaagaaggcagatgttgatgtttactacagaatctgtgatgagcattgctgggcctttggatttgcggagtgcgcagtttaaaatcacactcaccttcaaggagccttccttctttctgcaaataacttgtggagggctcactctgcacagcatagtgctgagtgctagagtctaagatggataaaaatatttaagatccctgtctgtctggggctcgcaccccactgggagaggtagagtcacacatgcaagtacataaatggctatgtgctataataaggaagctgggtgttgtgatggggccccttccgtggtctgaaggccatttaggatgtaccagtgctctgaaatataaagaatgggtagagatgaacttagacaagagggtggggagggaagcaacacgactcatttcaaaaataaaaatggttagaatttcccagagcacataagagctagtgagagaaaagacccaagaaaggagaagcctgatgcagaatcctaaagactgtgctaagaatgttcacatttatggcaaatgccatgggaggctattaagactctaaggaggctcaaattacatttttaaaagatccctctgatggtgtgggagatgagctggagagggacgagagtggatgtaagctcctcctttcttccctggtccaaagcagcatctctcgattcatcacacctaccttggatacagcctctgtgacggagtcttctctgcacctctgcaaatctatcttaggtacccctcatatgctccatggcactgtgtactttctccatcttcacacatgtcacagtatattggaattgcctgtttacttctctgtaacatcactagtctgaaagctttgaaggcaaggatcacatttatcttgtttacacttacatccccaatgccaccaaccatgttggttcacagtaggcattcaacaaatatttacacaatcaccatttcattgagcacctactgtgtgcaaggtacccttctagtcctttcatacgcatgaactcacccaattctgccaatactcctttgcagcatgttctatgattgtccccaaggtaaccgatgagtaaactgaggcacagaggaggctaggcaatgtgtccaaggttacaggctagtatgctgcaccactggggttcatagtgcatgcttacaaccacacactctaatgattaacaaaagaatggaattctcatctgttagagccagcatttaattatctgtgttaatggttcaaggcagtgtcctgcatcatccaaaacagtgagtaacttccaaataatccccagcggactctatgatacatatgggctttttttcagtagattgaccttcataaattaccacttaaaatagccaataacaaaacctattcctgttccctaagtagcaatcaaactaatggacaggaagtaactaagaactaaactggctaagccaaaaaaagcactcaatcaacaaatttaattaagcacttacttgttcttcttcaggatcctgccatggttcctgtttcttatcgctgccaagtctcttaaaagcatatgctacacccaccatctctatctacttccttacctcttctttctgcatccttaaatcaggtctttgtttgcacaactgcactgaagtggctctggcaaaagtcaccgatagccactgtgttgccacattcaatgggtcccttcatctccacagctgtccatggcatttagtcttctgtgacatctttcactccttgaaattttttctttagcaccttggataccactgcccatcccaggagaaacagacgaaaggacagggatccagagcaccctattttatttctcatctctctgtgaccgggaaaaatcacaaactcttcctctgccctgagttttaacccattgtgtgctgctatgagattaagacatccaggctctgtggctttcttttttctcccctaatcttacaggacagcacaaagaattttcataaggcagtatttcacatcaattagaaaatatttgaatcaacaaaacctccataatacagtatactgaatatatgaatccaccaaggaaattgagtttgttttgttttgtgttctagcaagggatttcatttaaggacatgagaggtacagagtttcaaagaagagggcagtcccaggatcatccaggctaggagggccctataactacatttaaacattgtgcaaaggtacaaagggcttgggctttgagatcagcaacttgggctagaactccaggtcagcaaattcctaagagtataaatttctgcacttacacttaagctcttgagactcgatgtctttatgtggaaaataagaatgatagaagagatagtgaagaacaaatggaacatataagctcttagtaagtgctcattttctctctttccctggtagagatgtagcttccccacatttgccagctcctttcaaggtgagtagggctgtgtgactggtaccatccaatcaattgcgagtatataggaagctcttagtaagtgctcactttctctctttccctggtagagttgtaccttccccacatttcccagctcttttcaaggttgggtggggccgtgtgactagtaccgcccaatcaattgtgagtagaagtcttccgtgtcacttctggctaatgcgttcatgagccactgcaagaccctccaacagtcccttttgttgtggcagcaacctggaagccatgtgatcaaagcagcttacatttctgagtcatcacctaaaagacggtcctatagagttgcctaaccagctttggaatttgcgtgagtgatacgtaagcctttgtcatgctaaaccactaacatttctgggttagtctgttcttacagcacagcctagattaccctgattaaacgcatcacccactggggagtccttgtgttcccaggggtggaagcaaggatgaatcagcttcatctctttttttagccaaggtctttactgatagcatctcctgttttcttccttctcttcccttcacacaccagaatcggatctctttattttacccccaaagaaactgaagtccagagaggccaagtgacttgtccaagctcacacagcacataagtggcacagccaggccaagaacccagggcctccgactcccctccagccctcgtagtgtccacactacactacctcccagcagcttccagcttcaaatgttaataatgttctgagcttgccatacctttcaatcactgtaagcgatacaatctatgctaccttaatgcactaattaccaaaggagcacattaccatgccctaattactaacaagaagtgttgtcaattcaccatcctgtttgccagtacatgcaaaatgtttccagacttgttctcaaggtttggctggaggagggaagacaaaatacaaagaacaattgattcatttcatattgacaaccagtcaggtggcccttctattattattctttgttacctaaacacaatccaacaaagccccagaagaaaggtagctgatagaatgagatgggtgggacaggcagtgtaatgagctccagaaagagatttgcccacctggtttagatgcccatctttccctttttgcctctagggtttttcaaagcctctgttttttcagtcataaaatgggtataaaagtagtgccaacctcatggggctgccctgggaattcagtagcatcacgcacacaaagtcctatgcaaaatggcaagaagataataagatgcttaactgttattgcctatgatgatgattgctatttaggggtagtttcttaatcactgatttttccaagaagattaaaaccaggcaacgaggccaggcacagtggctcatgcctgtaatcccagcactttggaaggccaaagtgagcagatcacttgaggtcaggagttcgagaccagcctgaccaacatggtgaaaccccatctctactaaaaatataaaaattagccaggcatactgctgggcacctgtaatcccagctacttgggaggctgaggcaggagaatctcctgaacccgggaggcagaggttgcgtgagccaagatcacgccactgcactccagcctgggcaacaaagtgagactctgcctcaaaaagaaaacaaacaaactgggcaacgaagtaaggataagggaccctgatttatcttttattaagcacttgcccattctatgatgtgacttcttggtaggtacattgctaacattctgtcttttaatctttattcccgtcctataaattagatatgattgtcagttttacagatgaggaaactctggctcagagatgttcagtaacttgtctgaggccacacagctagtaagtagtagacgcaggatttcaatccagggctacgtgcctttttttttttttttttcatttcacaacaatactgtaattcaatttcacttttcgtggactgtctgcctccacgcatctttatggaactatattttggaaactttaaagggactatgacttgagggcaaaggaatgagcacatcttctgggaccgccatttgggacataatcatatgcatttatagagcctttgctgtgtacctagcacagtgtttagtgctggggtcatagggatcaataagatgtagccctggctttcaaggcgttcaaggtttaacaagaaaactcgtacaaatttgagtcaattacaataacctgtggccgatatgcaacaaaactataagagcacagaggagagatggaactcaggagggacttagaagaagcaaaatctaaagcaggttttgaaaaattaaacaccacttgcgtgcggtttcagggagaaagggcattgcaggtgcaaagcagcagtgtgcaaaggcatgaggtgtgaacaagcaggctgtcctcaagaaagacaagcagccattctgctggactatacaaagcatgagaaggaagaggagcaatggggctccagaggccagctagtgtcaggtcactagggaccttgcactccacgctgaaggcacccagaagcagtcttggtttctaagccggggatggcacagtcaggcgggctttatcatagaccctgctgtttgctacgcaaagccagtgctggctgccaactctggctgcgcaggagactcaccagggagcaatttttaaaaatccagtgccaggacctcaccctggaccaattgaatcaggcactctggaagcgcagtctggacaccggtatattttaaaagctcatcggacaatcctaatatactgccaggaatcacgctactggtgtaggggcagaaatagcatccaggaggctagtgctggggaaatgaattctggatgaagagaaaggacaagattcaaaacaacaatattttaggagctaaaattgacaattgtgtttgatgagatgtgggagctgagaaagaagaggagggagggtgggtaggaagtgacgctccatttttttaatcttgatacataaatatattatgtgttatacacctcacataatattagtgccagagagtctaacaagcccatcagcaattattgatgtctcctcatccccgtactggttgtctatgagagttcaaaaatactacaatgattgaagaatgcgtatcacatcctacaagcaccatcttccatactcaggggtccacattcattccagtcaccctgcacggtccagagggatttgccttgaacccatcctggcctcttgaaggagaaatgcctggggaattccacaggaggaatgaaattgctgtctcgttagtgcattatttactttgatgcacaattctagcagttgcagttcaggctctattgttcacatggttgggcaggaagtgtaatgggaataccattaatctgatggttttaaaggaggtgatttccaattagaattattctcaagttgtgaaatgagtctgagccggtttgtaaaacagcgagtaatcaatgcactgtataaccttgattttttagagtcccaacgctatgcagaaaaaagtgtcctccgaacccattataagagggtaaaaaaaaaatgccatcatcctcccaccccccagacaaattagcaagaaaaatgttagcaaaaagctctgcagacgcaccattatttacaaaagggagagagaagaagatgctatgaaataaatcatgctgacagttcaatcaaaaaaaatcagaatatattattcatgctgtgtttcatgagttggaaaggaactggacagggagagccaaatatgtagttgtgtgctttatttatgcataataatttgaattcctaagttacctctgtttaatgaaatctgcgtgctaactgacctgacaggctcattcaacatgtattttttgaacttcgactcttaactagtgctggtctagatactggggatgcacaggtgagcaaaccaggtgagatctctgttcctgggaaggttagttctgcttgtgagtggggtggatgggcagacaataaacacgcaaacaagaggacagaggttcataatcggtgcccaagaaaaaagcaagcaggtggtgcaatagagacctgccacgggctactttgtactggtgattgggtgaggcctctctgcagagatgatatttaattctgtgacatgcaggagccattaaaagagaatcgagagaaaacgtactctggggacggatcctaccaaggccaagatgtgggagtaagaacaggttgggtgtgtccagtcaacacgcagtaggtgcatggactgcgatacagtgagctagcaggggcaggtaggagatgaggtccgagaagtaggcagagctttgcccaggcaagactttgtaggctgcaggaaggagtttggattttattctaactgcaatggaagccaaccagagcgttttttttttgttttgttttgttttttgagacggagtcttgctctgtcgcccaggctggagtgcagtggcgcgatctaggctcactgcaagcctcgcctcctgggttcacccgccattctcctgcctcagcctcctgagtagctgggactacaggcgcccaccaccatacccggctaatttttgtatttttagtagagacagggtttcaccgtgttaatcaggatggtcttgatctcctgatctcgtgatccgcctgccttggcctcccaaagtgctgggattacaggcatgacccaccgcgcctggccgccaaccaaagtggtttaaggggaggggtgataggatctgactacaagactcctgtggctaggttgatgattcagcactgtgctggactccatgagggatgacagggagagagcagtagtaaccagtgggtggggaggcatggaaacttgagtgggcttgggagtgacagtagggttatcagctaaataatcgaattgaagataaggaaatcttccagaaggatgagctatttgaagacatccatggtgagaggcaggagcaaacagtgggaagtttgctgagtatatttaagtcatcaacactaacacatttgaagaaagatggtattatgtgggttgccttgcccagagagcaggatgtggaagggcaaatgtgggcaggagagggtgtgataaatctcagaaccatgagaaacctagttactagagatgagacagaagagggatggtgggcccaattctggagtgatgattctcaactgggggcaattctgcatctcaggggacattaagaagcacctggagacatttctggttgtcacaacttgagaggcagcgctactggtatttagtggataaaggccagggatgttgctaaacaccctacaaggcttaggacccccctcacaacagagaattctctagctcaaaatgtccgtagtgccaaggctgagaaactgtggatggacagcagagtagaacaatcctggatttcagtccccagtgtgtgaacttgagtcaagtttttaacctccctgagcctcactgactccatctgtaaaacggaggtggcaatcatacctgccacccgtgggggtgtgcatagagctgaggcaattgaggtaataaccacacttgcaggtgcagcgggactgggaagaaggcagaggctatgccatatgcctggtaagtgtgagaggtggggccattctctgaattgggcatcagaggattggggtttgagttctcttgcacacagtgggtggacttttgggaagtgactcagccttcctatgccctccctattctggtgacagatatagttataaatatagatatagatatggatatacagacatacctgctctcaatacagaagcataaaaatcatgtttatgtggcccatcccgtagaggatagtctagtctgttcaggctgttataacaaaataccacagaccagataatttataaaaaacagatggccaggtgtggtggctcatgactgtggtcacaacaatttgagaggctgaaacaagaggagtgcttgagcctaggaattcaagaccagcctgggcaacacaacgagaccccatctcttcaaaaaaatttaaaaaaaaattagctgggcacggtggtgtatgtctgtggttccaggtactctggaggctaaggcaggagaacaacttgagcctgggagattgaggcccaggttctttggaggctaaggcaggagaatcacttgagcccaggagatcgaggctgtggtgagccatgattgcacccctgcactccagcctgggcgaaagagtgagggaccatgtctcaaaaacaaatacataaacaacagaaatgtagttctcaccattctggatgctgggaagtacaagatcaagtcaccagcagatttggtctcagctgggcggtccagcttctaggtcatagacggccaccttcttgatgttttttttcacatggtggaaggagcaagggagctctctgggtcctcttttataagggcaccaatatgattcatggaggctccaccctcatgacctcatcacctcctcaaagcccttccaatactatcacactggggattaggtttcaacaaatgaatttcagggggacacacatgtaatcccagcactttcggaggcagaggtggatggaccacttgaagtcaggagttagagaacagcctgaccaacatggagaaacccccatctctactaaaaatacaaaaattagctcgatgtggtggtggttgcctataatcccagctactcgggaggctgaggcaggagaattgcttcaacctgggagacagaggttgcagtgagccaagatcacgccactccactccaacctgggtgacagagcaagactctgtcttaaaaaaaaaagaatgtcaggggcacataagctttcagaccacagcacacccttttccaggttccatcctgtaaggtgggacagggcagagtgcaggcacaacaaacagcatgcccagtctcagcagaactgcctttctcgcacacagcatgtgggcccacttgtcccagatggctctccttagtaccacctgaacgcagctttatttaactcaacactagagagatggtcaaaaagaatcagccgtgagtgtctcacctagcacgaagtctcccagcctcagcatggtcgactctttggactggataattacctgttgcaggggtctgtcctctgcatttcaggatacgtagcatccctggcctctacccactacatttaagtaatgccaagttgagaaccactgaactagcatggtgtagtaataactcatcatcatcatcatcatcatcatcatcacctgtgtagatggacagaagtcagactcaaatcccaccgcttccccttactagctgtatggccttaagtaagccacagcattgctctaggattctgttttctcatctgtaatatgggtataacactttcctatgccgagaatgaagtaatgtataaaattcttagcacagtgtctagcacacaattgttctccaaaaagtccttatccttctttattgtacatgattgagagttacacagagttaggtcgggctcggcggctcacacctataatcccagcactttgggaggccaaggtgggtgggccacttgaggccaagatttcaagaccagcctggccaacagagtgaaaccccatctctcctaaaaatacaaaaattagctgggcgtggtggcatgtacctgtagtcccagctacttgggaggcagaggtggatggaccacttgaggtcaggagttcgagaacagcctgaccaacacggagaaacccccatctctactaaaaatacaaaagttagttcgatgtggcggtgggcgcctgtaatcccagctacttgggaggctgaagcatgagaattgcttgaacctgggaggcagaggttgcagtgagctgaaattgtgccactgcactccagccggggtgacagagtgagactccatctcaaaaaaataaaaaaataaaaaataaagagttacacagagtcaagacagatctctgtggctgggtccccagaacaaagtcctcctatccccttaaacagggccacagatggacagtgagtatatggtccaaggcttctttaaacctgccccgtgaacacttgctccctcatctatctacagagtggctgttattatttatgaacaccaccgtcatcatcattagcaaaataagaaactgttggattttcccccatatctagaggctgtcttgaccctatccagactcaaggacccccgaactttctgatcttccccctcagagggaggaaagccactaaaatgaagttcttataaggtcgaccgatgcacaccaagaaaaatcagcattgcagcaggccggggtagggcgtgggtggtctccctgacagcttgtttttaaatacttccaaacgaaaatgagtttgcctccaaggaactgcctgtgtgctggcagatccgaaagcggaagcaaagccctcatggctggctgcatgcaggcatcctgatgcggaagtgctgctaatttaaacccattttccaaggtgcccacagcctccatggggaatcaccaacactctctggagaagacgcttaatcacctgaagaagtcatgggaacagagaaaacaagagctgaaaaccctctccgaaagggaggcccccaagtgacattttcagcagaatattattctctaagcattgtcttttcatcctgtgctctcttgaaccaaatagatgattaggatttaagatgcatttgatgatattttcctggtagggagccagttgtgcccccagttctgtcccaccttttaatcttcttggtggagttcccgaaggaaatggaagtgaagaacttcagccaaatgcaagcaaacaccgcttcgttattagctgggccaatgcccaatagcccgatgttggacgatttggaaaaagctggtctatgcagcagacacttgataggtaccttcttcttaacctagatcagaatcttgagtgggtgcagcgataaaggaactctggatgaaagaggcgcagctgatacaactcaggagatagatcaccacgtgcataacggggaaggaggacagggagggagggagaggatatggctggtccagctcacctcatgcactgtcacaggtgcatggacagaacacgacagagggagattagcttggtacacgtctcttagaacacagcgaccctggccccaatcagtgtggcccaatccagggtttatactctgactaatcacattagcctcttcttctcccttggacgtgggagctagggtgaggatgcactgagcacgcttgcacacatgggacaccaaggccaatgagagactgaaaatgagtgtacctccaaggaactgcctgtgtgctggcagatccaaaagcggaagcaaagccctcgtggctggctgcatgcaggcatcctgatgcagaagtgctgctaatttaaacccattttccaaggtgcccacagcctccacagggaatcaccaccactctctggagaagacgcttaatcaccctgctatacatggagctctattttttttttttttgtttttgagatagagtcttgctctgtcacccaggctggagtgcagtggcgcgatctcagatcactgcaacctccatctcccgggttcaagcgattctcctacctcagactcctgagtagctgggaccaaaggtgtgcaccaccatgcctggctaatttttgtattttcagtaaagacagagtttcaccatgttggccaggatggtctcaaactcctgacctcgggtgatccacccaccttggcctctcaaagtgctgggattacaggcgagagctaccacacctggctcatggagctctatttatcaaggatttttccttgtgatacaaaataaaattggtcttcgtatccccactgccaaacactgggaatgggtacagaggaagtaagttcctgacctagcaaatatttcttcattcccttgtccttttatccactgtagcacaaaatagcttccttggccacccgtgtgagtcaactcttgtcctaggaccaggtatgtgtatgaactaaggtcagatctggatgggcaaaaaccatcccagcctccttccctcctgcccagtgacctttctccagccttttctggcaggctccgtcaattgttgattcatctcctgtcatcttctccatgcaacttagcaaaatattcattcattcagtgaatatttattatatgccttcatcttaggttggatttctccaagcagtggctgagagggtgatgtgggggcaggtgatctatcaagaaacagtgggccaggcacggtggcccatgcctgtaatcccaacactttgggaggccaaggtgagcagatcactgaggtcagaagctccagacaagcctggccaacatgatgaaaccctgtttctaataaaaatacaaaaattagctggcatagtggcacatgccggtaatctcagctactcgagaggctgaggcaggagaattgcttgcacctgagaggcagaggctgcagtaagccgagattggaattgacccttgcacctgaaattgatcgcttgcagctgaaacgcagaggatgcagtgagccaacattgaaattgaccctctcattcttaaagcttgaaacttatgtttgtcttatctgacttcctttgttaggaaacaaccttcaggccctcaggataatatcaagagaccgcaactgggaggccaaggcaggaggattgtttgaggccagaagtttgaggacagccctggtaacatggtaagacccctatccctaccaaaaaataaaaaaaaattagaaaattagctgggcttgatggtgcacacctatagtcccagccactcaagaggataaggcaaggatctcttgagcctaggagtttgagggtgcagtaagctatgattacatcactgcactccagcctgggtgacaaagtgagaccctgcttcgaagaacctggaattccacttctttaccccttcctaagttctgttttcctgcgtgtagctgcattccttcccagctatataaacccccaattttagtcagatggggagacagatttgagacttatctcccatctcctcagctgcacacctgaataaggccttttttcttggcaatacttgctgtctgagtgactggctttctgtgcagcgagccgtgcgacctacacctaacccttggcatttcagtaacaaaagctcttcaagaaaaacctctcaaggaaggacagtggaataaggcgaaggaaagaccagagagcaagaacatggtccaggtagagtctagccttcgccagatccccatgggcaggtctctagcacaggggttgacaggtttttttctgtaaagggataaataataactaattgagcatttgcagtcatatgatctctgccacaaccactcaactctgccactgcagtgctaaagcagccacagatgatacataagtgagtgagcatggccatgaggctaaggaacttgtctgtctcgcccatcaatgtgccccatgtctggaacacggtaggcaggaataaatgatgttactgcacatccaggcccctctactgggctgctgcatccatgatccagctgccataaatgttggctgatatggcttggagatgcccttctgatacagaaaattgcccacagctgacagaaaccaccttgcaaaaaagactacgctccaccctccaaccttcccagaagcagcccacagccaatggctgatggatatataagggcacaagagaccaaccctcctgcttcatggagggacacttcagtagtatgataccttctctaaagttgaggtcagcaaattatggactgtaggccaaataggacccactggccattcaactctgaattcgctctactgagcacagaccctggaagagagcagtcagagagtaaatgtttatcgaatacaatggaataaaattgaaccttgaaagacgggtccaatttgggcagggtggggagagaaaagcattctttcaggtcctcgaacatgttatacacgctgttccatctgccaccagcactagcctacctcccccacaccactttgcctagccaaccagcattgtctctcatctttcaagtctcaagttagatagatctgcccccagcatgagtccattgctccccatctgttctcctacagtacctttgcttgctactcatggaataattctcccatcgtgtatgaggtccttaagttaatttctctgtctcccgcactagaatgttggcttcttggagtcagagacctcacctgtctcagactcttccatggtcttagcatctcacacagtgcctggcacgtggtaagccttcaatataatatttcagcaattccactactgagtatatagccaagagaaataaaatcagtatgttgaacagatatctgtacccccatgttcactgaaacgttattcacagtaaccaaaatatataattaacctaagtgtcccctaaaggatgaatgaataaagacagcatggtagatacacaaaatgaaatactattcgccttaaaaagaaggaaatgttgtcatttatgacatggatgtacttagaggaaattatgttaaatgaaataacccaagtgcagaaagacagatatctcacgatcccacttatatgtggaatctaaaaaagttgaccttgtagaagcagagggtaggagactgtttaccaggagctgtgaagggggtggtatgggattggggaaatgttggttaaagatataaaatttcagttagacaggatgaatacattcaggagatctactgtgcagcaaggtgactatatttaatgacaatgtactgaatacttgaaaattgctaagagagttgattttaagtgttatcaccgtaaaaaatatatgaggtgatacatttaattagcttgatttagccattcctcaatgtattcatatatataaacatcctgttgtataccataaatatatacactttttatttgtcaactaaaaacagaaattattttgactctagatttcttttcatccaagttttattacaaaattttccaaacgtgcaaaaaagttgaaaggtttagtacagtgaacaccacttagattcaataactgttcatatcttacagcctatatattttaaataatagccatcattcttgggcatttactgtatgtcaagcacctgctaggtgatttgcaaatatcatttttaaaatcctgaaaaatagcatagaagataagcactattattctcccccattttgctgctgagtaaactgagacttagagaagttacatcactaaaatcaaacaggtactaagtgttagatttaaaccggatctggagtactgtagctgaattccggactactgcgttatagcacagtgtgtaaccccacaacgatatgatgtgctaggggatcctagaattgtggggctgggttatttctgaagagtctgaggcagctcctgcggggagatgactccagagagcaactgaaagggagatggagctgagacaagaaatccactgctgaagtttggtggccgatcatcaaagagattaactccaacagcatctaccccaacccctttcttccttgccatacatctctgacactaccattattagtgactgggctcagaagcttgccaccttgtatgatctgaattgatccagtaaagaattctctgaaaagcaccattaagatgatttatagtctaattttggttgctatagattccaagtcagacttatgactcggaagagaggggggaaaaatccccgcctcgcttagaattcaggcaaaggtttcagtattgatagagaagcatgactggctgggggaaaaaaaaagtcatatttttttaaagtttacagctaccactcctggtttggggttgctatagcaacgaagggccttggaggggggcacagtgtctgcggatctcactctacggagagctgattgataggtcgcctgaatactgtttagacacttctgtgctaggaaccagataacattagtttattaaaatacacgttaaaacaccagtcatctctcttgccccagcattttattttaatcattgttgttaaggaattgttaacaggctactgataggaatggaaggcaaatcccgttagggagctaaacgccatcttgctggggctcgcatgcacaggccgggcggcaggcccatgcagggtgcataattacgataatttggcatgactgattgtctccctctccccccagcccaacccaccctggctttccagggagttagaggcatggctaatcctcgtaaagacttctgttcctggctgtggaggggctccggctgggactgtgcctagctaaggtctccaaatttctgtcttctctgtcactgtgtgacagcctgcatgagtggcagtttgtgccccaagaagagtgtcatcagggccaatgtatatggcctgtccaatgtatcactgcttgggagatgtggtcaagacaagctgggcatgaaccctggtcctgctacttgctagatttgtgactgaggaaacctcttaagcctctgtttacccacctggaaatgggggtgctgatattacttccatttttttggagcataaataagacattccctttagccttctacctggaagagctcattcctcacaaacctgataagacagatacttcaactccattttgcagatgaggaaattgagggttagggaagctcgagagcttgaggagctgcctaactcctacagtttggggaagattcaaggatgcatgtaaactgcttagcacactacttagtacagggttggtactccatcaaagttcttaggtacatactattgacgttagtatcattatcagtggtagaaggtgaaacggctactctcatcatccaaagctcctgctggtaacacatgtctaagagcatgaataatcttcaagcacttggtgggctcttgtcacttttcatgattgcattaatcctcacaccaaccccatgagatgaggagcatcgttaatgcagttctacaggttaagaccttgaggttctcagagacaaaaatcactagcttggggccccccagctggtagcaggcatcactgggatttgaacccatgtcttcatcattccaaaccctgtttgtacccttatgttctactgtcagtgtacctatataaagccacagactgtgcattcacgtaggtctcctattgtcttttattcaacccacatgtgatgtgtgaattttctctgtgttaatactgagcaagacattctccaggcttggcttgaataccttaagagagttcactgtaaaatggaggccaacttcatagttagaaagttctccccagccgggtgtggtggctcacgcctgtaatcccagcactttgggaggctgagggcagcagataacctgaggtcagaagtttgagaccagtctggccaacatggtgaaacctccatctctactaaaaatacaaaaattagctgggcaagctgggcatggtggcacatgcctgtaatcccagctactcaggaggctgaggcaggagaattgcttgaacctgtgaggcagacattgtagtgagccaagattatgccactgcactccagcctgggtgataaagtgactccatctccaaaaaaaaaaaaaaaaaaaaaaagatctttcttatgctaagcccgaagcccagcctgcccacactagttcaaatctccagagccacagagatacagtatcttttcaagtgctagcccattgcatatgggagaatcatcatcaggcccaccttttataagttcccttttggttcatctcttcattcttccattcacctatccgctgttatctagtcatcctacaaacatttattgagcttctactgtatgccagatactcatcaggaacagggctgtagtgctgaagggcacaggcacagttctgcctccaggttgttcacattttagttggggagaaaggtactcaaaactattttttaattcatttgattataactcttaagaattataaaggggaacaataggattctaaagaagaaatgtaaggttctatgggagcccatcaccaggacaagtaggaattgatttggcaaggaagaatgttggaaggcaactcagtcaagatataccagagggaaaagcattccagggaaagtgagcagcatgtgcaaaggtcctgtggtaagaaagaactcagcatgtttgaggaactaaagagcagtgtgtctgtggagagtgagtgtgagagagagggagattccactggagaatgatgaggtcagaaaactccattccttgcctctcactttgcttctcgaacacagacaggagagtaggaactggatcctggatggagcctgaaggttggaaaagaagtcaggctctctcatatttcacctggacctcaatctctgaatatgtttgtgacagaatatgtttgtgccattgtcaccttattaagctgacaactatgtttcccagaaactccctccctgtagggtttcagcagaaaactgtcccacagaggaacttgtggggaattttaaaagcagaagtgaagctcagccatagccctcagaacgccattgtgtctgactggtagaatggtggcaggtgttcccaggaggctctggctggtcctcaccctgctgcatgccgtgtttctagcttgccttcctaaaccctggccctgcgaaccaaggaagctccaggccaccaccagatgcttggctgcagactcgcagaagcgcagccacacgctctggatggttctctgcagaaatatccgcgagctcccctttctggtctcacttcggctggatgtgcttagactctcctatttcccacttgggccagtgcttcaggcaggtgggctagtgactttttccgaagctccagctccccctccagacccccacttcccagctccttgcacaggtagatgcggtctaattcctgtaacaaatccttgctctcataataatcattatggctttgtttccctgactgaagcttgaccaacatgctggataacatcatcaatgggagaggaaaagagaggaggggagggaagaagacgggagagggaaaaggaagggaaaggaaggaagggaaggagatggaagatgagggagggaggggggaacttcctattgaactttgaactatttttttttaaattttagattcagggggtacatgtgcttgtttgtaacatgggtattacatgcatactggtgagggcagggccttctagcgcacccatcactcaaatattaggcacggtacccaataggtaatttttcaacgctcactccctcctaccctctccctttttaaagttcctccctagagtctgttttctccatctttatgttcatgtatgcccttcgtttagtagccaattgtgagtgacaacatgtgatattcgattttctgcttctgtgttagtttacttaggataatgtcccacagctccatccatcttgctgcaaaggacgtgatttcattattttttatggctgtatagtattccatgatgtatgtatgtatgtatgtatgtatgtacaatatatatatcacttttttatttgagacagggtctcactctatcaccagggtggagtgcagtggcgcagtcttggctcactgaaaactccacctctcgggttcaagccattctcctgcctcagcctcccgagtagctgggactacaggcacgtgccaccatgcccagctaatttttgtatttttagtagagatggggtttcaccatgttggccaggccggtctcaatcccttgacctagtgatccgcccgccttggcctcccaaagtgctgggattacaggtgtgagccaccacacccggcctatatatcacttttttaatacaatcaactattggtggacacttacgttggctccatgacatcgctattgtaaatagcgctgcaataaacatataagtgtaggtgtctctttatataatgctttattttcctttgggtaaacagtagtgaggtttctgggttaaatggtatgaactttcaactggtctactgaggttatcttcaattttcaattgtcttgagggacacaagacagtttgtcttgggagcaagtcacccttgctggcggatggccttcatttgataattgaggtaaacaagtttccacaatgagaggtgagatgagaacagaattccagttcttcttgttcttacttctgcattttcattccacacaagtccaccctgttgggacagcccattccatggctctaccccatcattcaaggatcaagacctagtatggtacctgggttcaactaccggctctgctactttctcagtgtgaaccttggtcaagttacctcacctcttatttcctcctatgaaaacagaaatcataatcatggtacctggaaatgttcaatgatactgtagatagaaagttctcagcatggctgggtgtggtggctcatgcctgtaatcccagcactttgggaggccaaggtgggtggatcacttgaggccagcagttcaagaccagcctggccaacatggtgaaaccccatctctactaaaaatacaaaaataagctgggcatggtagcacatgcctataatcttagctactcagaaggctgaggcaggagaattgcttgaacccaggaggcagaggttgcagtgagccaagttcacaccattgcacaccagcctgggtgcaacacagcaagactctgtctcaaaaaaaaaaaaaaaaaaagaaaagaaaagaaaaggaaagacaattctcagcacagtgcttggcatttagtaagtgttagtgttattcttattgttgttacagtaagtccaaatttctctacctggctttttatctctgagtcaagtaaaatatgcaaatgttagtcatggattttttttttttttttgagatggagtttcactcttgttgcccaagttggagtacaatggcatgatctcggcttactgcaacttctgcctcccaggttcaagcaattcttctgcctcggcttcctgaatagctgggattacaggtgcccaacaccatggctggctaatttttgtatttttaatagaaacggggtttcactatgttagccaggctggtctcgaactcctgacctcaggtgatctgcccaccttggcctccaaaagtgttgggattacagtcgtgagccaccgcacccagcctaatcatggttttgtccaacgtttccccagagcagcatgtcctggctgctttctatgagtgcttcactgctcttttacttgcatctttttcctggatccttaaactgccagtgaggtaggcacggccagtgctcttgtttggctatcccaaaagccattctcaacctgttttcctctacttacctcctactatggagagaataaagtcaggctagatagctgcagatagatagattctccctgcagctcagagtcaacatgagacccagctttgttccatgaaataaaaggggagaaattcctaaagaagagtgtttgggaaggcgttagttagtttcctgataaaaaggacaagttgtgttagcacttcccatactcctcctttctgccttggaatgtgattgcaatggctggttctgtggcagccatctttcacacataaggatgaggagttaacagctgggcatgggagaccgcatgtacaaaaagagcctgagttcttgataacaccactgaattactcaacaaaccctgagatgcatatgtgtccttatgttttacaccatttttcaacatgtcttttacttgcatatgaaagcattcttaactgataccagaggtcttactatgcctatttacatatggtggtggagaggctcaaaaggttgggcaaattgcaaaagttctcacagctttaaaatagcaggtttgaattcagtgccagattctgccagtttcaaaacccaatctctttaccaagaccaatgttctgtactcaatgaacgtaagtttctctactttaccttctcttctccatatatttaaattccattctgattttagttcaagttctggacccgccatgaatctttccttgattaatccagtacacagggagctcctgcttcgttgatccctgtttctccatgaaggcaccaccctaccgtctgacacttaatggttttccagcatttcaaatgcattgtacttttgacaccactccaccgaacccccattatatcacatgtttcttaaggtcagagaagcaaactcctatagggtaatagatcagaggatttggagactggttcaactcccggttcttcctcttgcctgttgtgtgtctttggggaaaagtcagttcatctactatggtctcagtctgatctatgaaatgaaggtcatagctgctgcgacgtattcaggtgaaacccatttgtaaagcaattagcagagtacctgacttggaatagatattcaaaaatgatagcaaccactgttattacatgttatatttcttgtatacagtcttagtgtgtggcagagtgacaacaaatagtatgagttcgataggcaactgttaacagaatggtccattgactatttcattaagaccttactgagatgtcattctattccagacaatgtgctaagtatttgactttaatgatttttttaaagtcaaataaaatacccttgtctttgacgcatgaacagataactgtaatacaatgtgacaaattcaataataaagaaattcatagggttttatggggacacaggggaagggtacttctcaaatccaggaggacttccaggaggaggtcccaagttgaatcctaaagaagagaagaatctggatgatgagtccttttccagtccccagaactctgttatccttgccaggagtaagttacagaaacagcagacgaagaagtggcatttgtgcatctgtgagtagggacacagattcatgtatatgataattgcttttgcatcttaggacttctatctagaggctggattagttagaaacaagcttccttttcaactttgctttcatttcagcttttcctcctgcgtggtaaacataaaacccattctgtaagggctctcctatttccttttaggcacgaagcatattcttagaagcagcctgccgggaaacaaaggttaattctgcagggaatgaattgctaaagctgcgttcttatttgaagttttgatttatggaagcaaccgtgggtttttctttgctttgcaaaattctttaatgtctccatttcaggcagatccgtcggcgtcactccacgcgtgggccaaagtcactggcaagattttatttgactctgctattcttaaaaggcaggagacaggctttgtcaggactcacaggacctctagcaagggatgctcagttggaaggcttccgtcccactagcccagccatgtacagggggctgtaaagtcagtaggcaagaacaaggctaacaggagtacttaaataagagttcctgcggctggtgcatttatgaaatatcagaaggtcacagaagtcagcctcaattggttactgtgctattgaagtgctgttgtgttccagctgtgagcctctgactggctctagctggtctgtaagggaatcaaggttggtctcaaaggccttccaaggttttttattgttgttgttcctatataagatattgctgtataacatggattgtttggtaggtctaagagggtattatggtctcctcttattcaattacggtatcatattgattcattcactatgtgccaggggtgatcccaaatagcactagacaagcagggctgcaacatatatttctgaagttcttgtacgacatgccgaagaaaagcgaggggttgaaatccactcgtcaaagctatgaacccatgcaaccggcatctaccaagaagatgtgactttttctaacccacctttttggagagggtgtttttttctaattcacgcagaggtgcacaggaatctagtttaggctagcctctaccctgtctacaagataatcgtagttcttgcactcatgaagcttttattctagaagagaatgaggaacaagccacaggtaaagaggcaaacttaaaatattgaagatgacttcatattaagtgcaaaaaaataaattattagtgtggtgttagcacagtgatggcggaaggatgttaccttaaatagtcaatgaagacatccttaattattagcctatgagctcagactgaaggtacaaaagaccaagctagtgaaaagctaaaggtccaagagtattcaaagagtccaacagtctaactacaggaagttgaatgtagatttcccaggacatttatttgagagaaggggagcttcccagtaatagcaatcgcactgcatttccctctagcttctgacattgtttttgtgctcagaatcaatcgattccttgctattcttggtgggcagaaagtctttgcaaaacttgacctttcccaagtgttatcaatacagctaatagtgatgctgtcagaaatgtccaacaatcatcacacatcaaggggctttctgagttcagcgctcttggttcagagtttctgctgtccttggaatgtgtcaatgtttgttgaagattatttctttactgaagttcaattatggtgtcatattgattcattttatgtcttatatttttacatgtttatgtgtctgttttcaccaataggctgtgggttcccaaggggcaggggttctgtgtcatttcattttgtgcccccccacaataaaacagtgtagagttcaaacagttagtcaaggcagtcaatactttcatgtcctatgatggtcacatagtcacatggggtgttatttcaatactttgcttaactgattggcagactgatagatgactaggaatttcaaagtcgccatcctagggtgatgaccttcacctacatattataaacaacttgagaatgagtccacgcatttttcccctacttgggtagtttgtatatgtgctgccctaacctgtcttcttaaagggccccccaaaaattgactctgataaatcagtgaataatgtaatatttactgaagattccatggggtaaatatgagtttacattgtgcaccaaagttaacaacctaaaatctctttgatatttcttttaaggaaagccttctcttccgtactgtctagagactgtgtttttctctccctaatgtcctaaacagccccccaacttcactgacatctctttttcctgactacatggagcctttttttgttcccaaatcatttgtcagagcttatcttctaaacaaccattgcactctgttcaagtggagtttgcataacagcttcttagagaatagtccccatgttgattggcctatagaccccaaagtgttttgagcataatagatgttcaattaacagctaactgaatcaactatagcccagtgccattatgatatactgtgctataaaacaaaaagggagagagattctaatctttctcagattcctcaagatctgcttcatacttctgttgtaaggggaggtattgctgagccctgtcatgctgagccctgtcatcagccaaaaggcaaacagagtttctttagtcctagtcttgccagaatgggggtcactccggaatgttaaccggttaataattctaaaggtgcacaactgtatgtacgtgggataaaccacttcctactcagccactttatggtttaggaacttgtctagtgccaaaaagctaatgccattgggaccccagttagtgactctccctcaattccttcttccttacatggtttttaaaatattgaccttgctggagtttgaggccagcctggccaacatggtgaaaccccatctctactaaaactacaaaaatcagctgggcgtggtggtgcgagcctgtaatcccagctactctggaggccgaggtaggagtatcacttgaacctgggaagaggaagtcgcagtgagttgagattgtgccactgcactccagcctgggcgaaagagtaaaactccgtctcaaaaataaaataaaataaaataaataataaaaattaaaaaaataaaaaaaccttgccaaaaggctacagtacctgtgttatgacacttctcccaggcctcagatgattgatccagagtggtgcgtgactctagttaagagtcaatcacattctctttctctctgtcggatatctggaattgaggcatggagacagaattaggtgctgaactggaaggttctgtagacctctgtatcagcagatgatggagcagagttggactaaagagaaaggacatgacatgggcagagacatagtaagagttcctgatgattttacagttcccatgatgtctcccacatttgcatttgtttcaatgaaattccccctgaatcttttttttttttttttttttttttgagacagagtctcactgtgtcacccaggctgaagtgcaatggcacgatctcggttcacctcaacctctgcctcctgggttcaagtgattctcctgcctcagcctcccgagtagctgggattacaggcatgcatcaccatgaccggctaattttgtatttttagtagagacagggtttctcacgttggtcaggctggtctcgaactcctgatctcaggtgatccacctgcctcggcctctcaaagtgctgggattataggtgtgagccactgcacctggccccctctgaatctttataactgcttcacttttcatttgtcctcctttgcatgtgtctctggcacataaaccaaactatcctgaactaaccacaccttgtcaccaaaacagaggcaaccaaccctcccatgcaccttgcaccaggggcacctcttaacacattgaattggaattcatgatttacagatttctctcttaccaggctgtgagcaaattgaagtcaaggtctatgattttgtccctatatccctactatctaactcagcaccagggacatagtaaatgcctaataaatgtttgttgaatcaaattaaaaacaatgtcatctgcagaataaaattaggttcctatcgatttgttctaagccctatttaccgcaggagaccaggattctacaattagcttacagccatgcatttacatcttgcaccaatcacaagccactttggggactcttttctaaaaataatcccattcctttaattatatcactgcctctggcagaaccagattgccctctgtgggggcttttgaatgcaaatgtatgtgtaagcctgcgtgtgcaatactgaacgtcggtactagagccattttcattattcaataagcccttgacccacctcttcagactaatggaattacactattagttgtgctgtctactcctttcttttgttttcttctgattacaagggtaatgcaattagagataattctacaatgatgtcacaggtagccttggtgtccacctccccgccactgagaatcaaaatccatttacctacaatatcgtaatcttgctctgccccaattggtcttcagcatccttttagccaacgctggtaggaagttctacaggaaatatagcgaagcctgccagggttgcctcttctgccattataaaatgttacttgcggcaaaagcaagggattatttttcttatatgctgtgtagttcaccaaaatggtgctgatggtatttaaaaaacaaaaacaaaaaaacatgaaggcagggcatggtatcttacgcctgtaatcccagcactttgggaggccatggtgggaggactgcttgagaccagcctgcatgatatagcaacactctgtctctagaaaagaaaaacaaattgatagggttaataaataacaaaaatccatattctaaaacaataaagaaacagttatgcaaaagtatgatttaaaaagctttgactagaactgaattaactctgtaaataattagaagcaatactgaaaggtgatcatttatgtccacttaccgtcaattttgcctgggtatttcaaaatgagctaataaaaaaatagtaaagcatgttttacactgtagttcttctttgtcgttctctccaaaaccttaatctttatacattgtaagatcaaatatctaaaacactacatgtatattatttttacaaaaatacatagaagtttgattctatcttaaattggataattcagaattagataccgtacctactatgccatttgatctacatgtaccttttcctagaatggtagttctcaaacccctattcgtgttagaatatccagtgaagctttttaagtgtttgccctactcaattcaattaaatgtgaatctctaggtatgagattctaatggcatttcttaaagtttctcagatgattccaatacacaacccagacagagagccactgtcctcagaaatgtttgggagtgcatggctgggtgcagtgactcaggccaggtgtggctgctcacgcctgtaatcccagcactttaagaggccgaggcaggtggatcacttgaggtcaggagtttgagaccagcctggccaacatggtgaaacatcatctctactaaaaatacaacaacaacaaaaaaaattagcggggcatggtggcaggcacctgtaatcccagctactcaggaggctgaggcaggagaatcgcttgaacccaggaggcggagggtgcaatgagcccagatcgtgccatggcactccagcctgggtgacagagtgagactccatctcaaaaataaataaataaataattaaataaaaataaaaataaacatttgggagtgcaaatcacctgtctgtcttaaatagcaaacttctcactttccaaaacatacctcaaaccactggattcagacaagcagaacataggcataataatgaggaccaggtttggggaaagggctgtgtagtatagatgggtaagcatctctgtggaagtaatttgggtcgtatctatagaagttagatacctcagccagcacatcttctattgcaaatttgcagagcacacttccaatcagccaatgttaatttggttaatttggttgggggtcagaatacagagtacagccttcctatggggaagcctcattagtcatcattaggagtatccattctgcctggttgtcttagagtctttgcctttcttattacaaagtattagatagaacatgagaggatgccaacagccctgcagattgaacaagcaagatgtcttagaggtgtggatagcactttacactctcccaatataaaacatttaaattaaatattaaatcattattattcagttggtcaacagttatgatatggtcactataaagaaaaataagtacagtccaaccagagtaaaggaaatgtatcctcagaactctgaattttcaggtttgggaggtattgggaggtactttagaagtcaagcaatccaacttctacattttatgtatggaaattctgaggccaaaagaggactgcaactggggtttctaattctcgactgccaatctttcttcctaatcctggaagtctgttttcttgatcttatcagcagttgactttttaaaggcactgcctcctcatcccatagaatggattactattatagcattgcaggatgaacatggtggcaggggagtacgtggtttccatggttaaactggggtataaccaggacaggaacactggcctcctccctgcaagtctagaatgaccacacgactgtgggccccagacaaaccgaccatattctaatctgaacctccagctcagaaagtgttaagtgtatcatcttggacaagataattcacctccatgaatatcagttttctcataagtaaaacggatgtaattttttaaaaaaaatctgtcttgcaggatagttgtatagatacagtgagatctttagaggtcagcagactttttctgtaaaggaccaggtagtaaatattttaggctctgcaggctacatgaggtctctgctgcgtattttttctctctctctctgtcttacacacacacactttaaacatgtttaaaaataaaataaacattctgagcttatggaccatacagaagcaggcataggtcacagttttccacagctgatcaagaccacacgctgcaagcatgcagcaaccaggcatgtctttgtgttgttattcagcacccagcacccaccacagtatcagatgcttgggtatttactcaacaaaactctgaataaataatatgtaaagaggctgggcgcggtggctcatgcctgtaatcccagtactttgggaggccgagacaggtggatcacctaaggtcagaagttcaagaccagcctggccaacatggtgaaaccctgtctctactaaaaatacaaaaaaaaaaaaaaaatagctgggtgtggtggcgggcgcctgtaattcccagctactcaggaggctgaggcaggagaatctcttgaacccgggaggcagaggttccagtgagccgagatcgtgccactgcactccagcctgggtgacaagagtgaaattctgtctctaaataaataaataaataaataaaatgtaaagagcctgatccaaagtctaagatggaaaaggcactgtgtgtttatttagcattgttactgcccttgtggcttataagctccagaactatgatttaatatgaaagacaggatgagttcactcattaaagtatttggaggaaaaggagatgagtagaagtgttgcagaggaggaggcactggcctgagcttggaaggatgggtaagtttttggataaatggataaatgaagaaggtaccagtgtattaaaaggaaaataaggaggttatgcatctgccactgtaccacggtgtatatatgctatcaggacaaggttatggcttcacaaagaccacctccttatgtgatttcttggaatgtggaactcagtggctgctgaagtgagatacaggtaaattcccatagggagaactgacctctgatcattttgagtttcaatgagagtagaatatctctgagacaaatatagacctattaaccagtgaacattaaaagatactgaaggcctcccatgactcaccttgaaatagagaggaaatgcgcccagctatcttggtacaatgccaatatctcaacacttacagaagctgattctgcacacaaattgtgcttgagcctggaaacttcaggggacccagacacctgagcagtatagtcatattctgagttactgactttgcatatgaatgtaaattgaagacctttaattgagaacctggacctagatggctgggcaaagtggctcacacctgtaattccactactttggaaggccgtggaaggtggatcacttgagcttaggagttcgacactatcctggacaacatggtgaaactccgtctctacacaaaatgcaaaaactacccaggtgtggtggtacgtacctgtagttccatctacttggggggctgaggtgggaggattgtttgagcctgggaagtggaggttgcagtgagctgagattgtgccactgcattccagcctgggtgagagagcaagatcctgtctcaaaaaaataaaaaataagaaagagaaactggggctaggataatagcaattgtggttgagtatcgttacggataaacactttctccttcttccctctcccgctatatattccctccaacacacatgctcagaggagtttttgccaggccagcattaaggcttagggttgtgttaatctaatcactaaaggaaatgtgacttaattaatacctccaagcttgtgaatggcaacataccactgtgtaaacataatcacactattccttccatcttcattaacagatgagaaaatagtctcaaaaggtgaaccagcttgctcaaggtcacaagctaagcaggggagtaggtctttctgtcttttcactaaaccctgtggcttacctaaagaatgaattataaatgcctagcatcaggtcatctctcagaaatgggttttggagggcagaagactttctctgagcaagaatttgaaagacagacaggggaggcagaaagagtgaagataaacatcaaagttgttttccttgggtagagaaacaccagattccatcaatcaagttagcagggttctctggtcttctttgagtactggagcttggattatgatgacacccagctgactgtcaggccactgttgcagtcaaaatttacacaaagatcgggcccagggttgcaacgcaggctacacaaagctgctggtacgaggagtcaagaagaaacagacattggccaagaagacaaatcatgtgccgcttcctcattcggaataactggccatgtctagtaaatgcaacctctagattcatcatgccagatgggttatttcaagtacagatgctagtatttgttctatttcattcaactctttgagattgatcaataaaaagatgtatatggtgcctgtgtgtctggcattaaaagaggaaagaaatgacctcagtgaataagaacagtacttggatttcttagcgtgcctaggaaaccccgagtaaactgggcagattcaagcatgtgatgaatttctgctgtctgatttaatatttaatattttaatatttaatcctaaagttgtgcattccacttctttggttacagaatattaagaagtgaagctattaaaaacactaagtgttttagttcaggaagagagcacaaccttccctaagtgacaggtgatgctgggtgtcttcgtttatttgtttttgaaaacgtgggctttatttcttaaatatttattattaatgcaacaatcaggctacccaggatttatatagaaccttgtcttccaaggaatactctggttgaataacatcatctgtctttatgaacttcaccgtcaggaagaaggcgagactaacttttgatttcttacagatgggaaaacagagaccctgagagatcaaacaagttttcccaagttacagaataaatctattgaattccctcacacttaatgctgctcaaaccagcttgtgttgtctatgacaggaaaatctctgctacagactttcagagaaatgtcccttccacttttcatttgatgaccactcataaaccttgacttacaagaagatatacgtgaaacggagacacaaacattgcactgcaaatggctcaaatattcatttgtggaagaaacacttaagttcctactgtgtgcctagctctatctaagcactagagctgtgttttcacttcttattgctgctgtaacaaattacaacaaaggtcagaagtcctaaaatcaagttgtcagcagggctaccttccttctgcatgtcttgggcagaatccatatccctgccttttccaggttctaatatatatattataatatatattatatatatagtattatatatagtataatatatagtattatatatactatatatagtataatatatagtattatatatactatatatagtattatatatagtattatatatactatatatagtataatatatagtattatatatactatatatagtattatatatactatatatagtataatatatagtattatatatactatatatagtattatatatagtattatatatactatatatagtattatatatagtataatataatactatatataatatatagtacatattatataactattatataatatatattatatattttatatattataacatatcatacataatatataatgtaatacacatataatatataacaatacatcacacgtaatatataatgtaatacattatatatgtattacattatatatatacccccaaaaagtaaatttttaaaaaaatgtgcttccctcaaagcattgatcagaagattaaatgtataatgtaatacatcctatattatatatgatatatataatatatatgatataatatatatcatgtatatgattatatattttatatatatatatatagttgattgattaagttttgagacagggtcttgaaatattgcccaggctggaatacagcattgctgtcaagcctcactgcagcctcgacctcctcagctcaagccatcctcccacctcagcctcccttgtagctgggaccataggcatgcactactacatccacctaatttttctttcttggtagagacagagtatatctaagtttcccaggctggtctcgaactcctgggctcaagcaatcctcccagctgagccttccaaaacactgagatcacaggtcccagcctttccagcttttagaggccatctgcattctttgactcacggaaccttcctccatctttaaagtgcatcgctccgacctttgttttcatcctctcatctcctttttctgactttgactctcctgccttccttttatgaggacccttgtgattctatcaggcccatctggataatccaggataatctcctcatctcaaatccttaaccaaatcacatctacaaagtggcttttgccgtcaggtaacatagtcacaggttgagtggattgggatgtgaatatatctgggaggagagacattattcagcctggcacagactgtcaagaggttttctagcccttgcagcaatcttcatttcgtgggaaagaggtgcacaaacaattgatgacaaacaccatggtaagtgacaagcagtgatgggtaaaatgatgggcctccatcccaggctaatgggggtgaggaagacttccagacagaatgatgtctaaagctagtcttcaaggatgaatgaggaatgctcatgcaagagagcaaggtagcatgttggaagttgggtcgtccaggaaatgaggacacagcaggcaaacagcacaccagaggccgaggagagtccagttgtacagttcatctgcctatagtgtttgcttcgcattggtcagctttgttttagagctaccttgggtggcagacagacaaaaaactaggctgtatagcaaaaaaattaagagtaagagcaggccagtcgcagtggctcatgcctgtaatcccaacactttgggaggccgagtcaggcagatcacgaagtcaggagttcaagaccagcctgaccaaaatggtgaaaccccgtctctactaaaaatacaaaaattagccaggcctggtggcaggtgtctgtaatcccagctactcaggaggctgaggcaggagaatcccttaaacccaggaggcagaggttgcagtgagccgagatcacaccattgctctccagcctgggtgacagagcaagactccatctcaaaaaaaaaaacaaaacaacaataaaaacagtaagagcaggaggctgggcatggtggctcatgcctgtaatcccaccactttaaaaggctaaggcaggtggatcacttgagttcaagagctctagaccagtctgggcaacatagtgagaactcatccctactaaaaaaaacataaataaataaaaaattaaaagttgcccaggcatgattgtgccattgccctcccacctgggtgacagagcgtgaccctgtctcaaaaggaaaaaaaagagtaagagaaggtaatgtgcccttcattcaagccctgatccttcttaaaagtttgtttaacttctctgctcctcagttttctcatctgtcaaatgggagtaataagagtactaatcttaattgttccaaacataaaataattaatataaagtccttagcacaatttctggcacatagtgggtgttcaataaacgttagatttttctcttttagttccctccctttcagcctctttggcaccaggacactgtcacacagtatcttagtctgttcaggctgctataataaaataccacagactgggtaatttataaacaatagaaatgtatcactcacagttctggaggctgagaagtccaatatcaaggtgccagcagatctgttgtctggtgagatctcactttctgcttcaaagatgacaccttctagttgtgtcctcacatgaaagaaggggagaaaaagctccctctggcctctttcacaaggtcactaatcccatttatggaggctctgttctcataacctaatcatcccccaaagactctacctcttaatactattgcactggagatgaggtttcaacatatgaatctagggagatgcaaacattctgacaacagcacacagttcgtgttttcacccatgccgggaaactcctacaggaagagcaggtgactttccctcgagagcctagttcccagggagccatcaacacatgtcccatcacagagatgacaaggacttttataggatgtgatgtgctacgttaaatacggttcagaccaaacaagaccatgccgggcacacccataccgtcaggtcctctcgattttccgtggttggaatttcacttttctctgtcttaaaacagccagatgggcggttattcttggggataaacaaatagctgtgatttctgtttatgggaggagccctaactttctgggtttttccccacaacactgacagtgtcaggcagattaaaagatgtggggcctggcgcggtggctcacccctgtaatcccagcattttgggaggccgaggcgggcggatcacgaggtcaggagatggagaccatcctcgctaacgcggtgaaaccccgtctctactaaaaatacaaaaaattagccgggcgtagtggcaggcgcctgtaattcccgctactcgggaggctgaggcgggagaatggcgtgaacctgggaggcggagcttgcagtgagccgaggttgcaccactgcactccggcctgggcgacagagcaagactgtctccaaaaaacaaaaaaacaaacaaaaaaaaaagatgtggagctcgagccagatcagctgctaggaaccacacccctttagtcaagtgctataatctcagtttactcaccaacaaaatgaaaactttgaatgagaagatttgtaagagcccctcctagatctaaaattatcttcttctatggcaagtttagagcataaatagaccccaactacaagaagtcaacctgaactgatgggaaaaacaaaattctggggtcagacaaatatgtgctgaaatccttgtgagattcacccacagagctacttaacttccctgagtcttggcctctataaaatgaggataaaagttcttgcctcaaatggatactccatttaccctgacatgattattacatatactttgtatgcctgtattaaaatatcccatatatcccataaacatatacacgtactgatatggtttggctgtgaccccacccaaatctcatctcgaatcgtagctcccacaattcccgtatgtcatgggaggaacctggtgagaggtaattgaattatggggtgtggtggggattatcccatactgctcccgtggcagtgaataagtctcacaagatctgacggttttataagggatttcccttttcacttggccctcattctcttttcctgcctccacgtaaagccctttgttcttcctttgtcttccgccacgattgtggggcctcctcagccatgtggagctgagtctattaaacctttttcctttataaattaccctgtttctggtatgtctttatcagcaacgtgaaaacgaactaatacacctaagatatacccacaaaaagtaaattttttaaaaaatgtgcttccctcaaagtgttgatcagaagattaaatgagatgtcataggtaatggaaagtcaggcacaaaatcagcattgaatgattattgaatacaaaagtggaaaggggctatgtctcaccaaagttctgtcttcacattccagcggccagcccctgttctgagaggttttctctttaaaatgttaattttttttcaaaacaataaaaacatcagtcctcttccccacccctctctaccattaattactgctcttaaggggaaataacttttaattttcaggcctttttcatggtagtttccctccatatacctaaataacatggttatgcagctatttctcaattgatcaattttaacttcttgttaatggtattgaaagacttagtgcctcctcctgctcctgcctctccccatgcactcacatcctagtttagtgatatcccgttgtttttgttaaatcagtaatcagtatatatgttactacagctattatcacatcctgctaatttagtgatatcccattgcttttgttaaattaataatcagtatatgtgttactatggctattaatccaagtagaatacaatgattaagtttcttcttcatatagatttagtttttcctgatgttaatgctttttttttctgccctttgacttattttttatgtacccaacatgaattcttcccagaaatctccaacagaacactaaacaaattttaatggaataaaactccccggcgcggtggctcacgcctgtaatcccagcactttgggaggccgaggcgggcggatcacgaggtcaggaaatcgagatcatcctggctaacacgatgaaacccgtctctactatcagtacaaaaaattagccaggtgtggtggcgggcgcctgtagtcccagctactcgggaggctgaggcaggagaatggcgtgaacctgggaggcgaagcttgcagtgacgcgagattgcgccactgcagtccagcttgggtgacagagcaagactccatatctaaataaataaataaataaataaataaataaataaataaatataataaaactcatcagtaagctatcagtccttttataagaagtacctcttcgagacaccttcccccgtgtgaatgtgttccactctagacctgctacctcacctacctccttccacgcttcatcccttcccatcctgctgggtttacattgaacttctctcctccactgaatcctatttctctgatttcctatcttatttctcttgattttcttttttctcttgagatgaagtcttgctatggcccctaggctggagtgcagtggtgcgatcatagctcactgcagcctcgacctcctgggctcaagcaattctcccacctcagccttccgaatagttgagactacaggtgcatacccccatgccctgccttgactttctttctttaatttttggagaggaatagcctcccaaagccttttcaggtacaattttgagtccttgcatgtctgaaaattttcattatatcctcgtacttgattaatcatttgattggatatagaattctaggttataagtttgagagcatggacctattaccttccagcttctagtatttctattaagacattcaatatcaattcttatgcttaatccttttaatgtgacctgttattattcccttgaagcttttaggattttctctgcatccccagaattctgtgacttaagaatgatgcaccttattacaagtttttaaatttattttactggatactcagtgattccctgtagtctagattttcatgtctttcacttccggtagttttgctccatatgtctgaataacatggttatattggttgtttcttaatttatcaattttaacttcttgtaaatggttttggaagatttagtaccacccccctcctgtctccctcacacactccccaacacttttacggtatttattctttgatagtcttctccctgcaattttgtgtctcctctctttgcaatttctgggagtcccacatacaacttctgaattgttcttctactttttttatatctgctctatgtttttaatctttgaatcatgtttttgccttcttgcaaatttcctttttcaactatgcttttaagtgacttacctttctgatttttaatttccaagagttgtttcttattctcttacagttcattttttaagtagcatccttctcttgtggcatggatggaatatcttctttaatctctgtgaggctcttaattatcatttatttgaagttttcttctgctgcctgtattgtctgcttttcacaagttgcattagttatattgtttgtatgttttagtttgttcctcaccccatgttgaaggctttccttaagtacctgattactctttattttgtattaatagttgagtgagataaatctctctctctgtctctctctctctctcacacacacacacacacacacacacctcacactaatcagaggctctatggataggattcaccaattcaagaattttatggaccaagccattctgttaagattatcccaaatgtcagtatccatatttacttttttcttggtcctttctgttactttcagaaaaattcttctaagccagatacagtggctcaagcctgtaatcttaacacttttggaagctgaggcaggagttcaagatcactttgggcaacatagccagaccccatttctacaacaatcttaaaaaatatttgaacccaggagttcaagatcagtttggtcaacacagtaagtccccatttctacaagatgtttaaatgctggcttccagcattccagaagctcagagaaaatgggctgggtagccacaccattcagtgtactgattttcattcactcttcccattgtcgaacctcacatgcctattacccactgtctgatatttgtgaataaagaccctgccctggttcaatttttccaaatcttcacctccacttccctgcctgggttcacagggtgggattgggtgtctgggagtctatctatcaactagctctcttgtcacgagcacctcctttgctcatgctatctgaggtacctgaagcctccaactgctgaaagtttctgaggttctgtgacccaattccccttgattttggtttataatctcccctcagtggggccttagatttcagttttcttcactcggttactttggttaccattcatcaatccacatactactgctcaaaacgcagttgacatctcttgtccaatattgtcttgtctcttattctagattccccctctcatcctagtttctcattctattcatactggtttatctcttctgtgccatttaaatgggagtctctggggaggaatggagataaatgggtgtgttccatctgtaatgtttaactgtaatgtttaatgttctactgagggtttctttcagtgaaagattttgcatgtgggaaacacaaggaaaaatacagagaatgtgcttccctgataaagtctctccctgggctgctcattcacaatggcctcattttctagagtaacagaaattatctagggccactctgtctccctaaagaactggatgacattatcttgaattccaacctcacctctagttcacctgattctcatcattctcaaaatttatacttttcctaggaatcttttttctctgctcagatggactgttttctttatatctgtcccagcatcatctcaaatctgagacacaagactttttttttttttgtcatttcagtattccatctcccaatcccccaaacacaaaggaaacacccttctgaaaataatctgcctgtagaagactgaagactggaaagtaatagtttcttctccagactgaatgctgataccagatggtgagattttaatttttctaatcctgctaccatgtctgtgtatacgtttatttctaaaatgaacacaaaaatccaaatagcatgggccttctatgtactctgatagaagaaatgagaaaatgatggtcttcaatcaaagaagacctgctattataagccaagaatccttataaaaagaaacatttaataggatatcctatatctgcttttgatttccatatcccaagaaaggaagaagatatttagaacaaggtcaagaggtgacaaagaacatctgcctgcgttgcttcatttaatcttctcaataagtttgtgagatattatttctttctattttccagatgaggcaatagaggctatgtgacttccctgaaacacacagctagaaagtgacatcaccagtaattgtaatggtaaccgtttctgccccaccgtgcttgcaatacacagtgatagattacatagatatatagattagctatagatatatagattagatagatacatagatgagattagacacatcgattagctagattacatagatacatagattagatagatagattagatagactgcatagataggatagattacatagactggattatagttgtgtgtatccatatacatatacacatgtatgtgtgtgtgtgtgcgtgtgtgtgtgtgtgtgttttcactctcatgattacaaatagatgatattcttctttctcatttttggaaactaagactcagagaagttaagtaacatgctcaaagtaacagtcacaaagtgcccatctctccccctctcttttcttccacctcctcacactgtctttaactagtgtccagagatagtgcccagtaatccctccccatcctgcgtgcacttggcactcctgacataaagaggagaggtatattttcccaacccttgaatcttggttggctttgtgactaactttgacaaagagaatgtgacacaagtgagattctgagcttccaaactcaagccgtaagataactggccactcctattccctgcgtcatggaattcagacaccatattgtaagaaactcaagctgcatggagaaaccacgtggaagagaatggagatgctctggtcagtagccttaggtaaactcctggctgaaagccagcaccaactaccggcttcatgagggagccatcttggttgttccagccctatcaagccctcagattatttcagtctcagtcaacagcatgtggagcagaggaatcacccaagtgagctcagtcaacctacagaaacacaagatagaatacaagtcattgttttaagctactaagtgttgacgtgttttttgtgaagcaagagacaccaaaacactgcctatctttgaaagcatgattgcaaaacctgatgtctttctattagagcaatttcactgacacagtctcttccactaagaataaaaatggcacgaatcattgagcacctagaaatgacaacatttgaaaacaagacactcaaggataacttagagatggcaaattaaaagctcatatagctttggtaagagtgtagagaaacaggaactgttactcatttactgtttgtggtagtataaaataatgaagtgttcctggagggtattttggcaatgtcttataaatactcagaccccttgacccagatttgtcacttgcaagacatttatccttgggaaccataaagacatatgcaactattttttcctgtaaaagtgtttactataatgtttggtataatactctttataacagtgcagagaaagaaagagaaacacctaaatatgcaacaataagggatttaagtaaataaaaatattttcacataacggagagttactacattgccactgagaataaggcaatgaaagtttttaatggcacaaatgtgcattcaatattcagaagaatatatgagacaatgtaagccgtttccattggtttttgtaagcaacaaccacaaaaattataactaacaccaagataggactatctgccaagcactcttgaaggacataacatcaaataaatagtgattgtctttcagtggtctcattacttctgctttatgccttttaatgttcactaggtattttttcaataaacatatgagaagaatataaaaacaacccactattatgagctgagatataatttttgaaataggttagtaactttgagatttctgggatgatttaaaaaaacagttctgccattctgaaattgtcatatgtacaagcatacattctcatggggcatttttgggacagtagcttcggccaaattccagagcttgaaagagcccctgatctcatgcatatttttagtgcatacttttaggccaattctgagccatctcctgggactttctgtaccaggccagttcccagttttgtttctgccatatgcattaggcaagagattccaaggcattctttgcaggggttggatgaggtacacattcagtttcattgcatcccagaagttttaaactccctggggattcagaacatattgctaccttacactgtataagcctgggaaacaggggtccacctgcattctcaaatgaccctcctgcaattagaaatgagatttctagtaggacttctatttcagtgttaacaccagacaatagcctttggctctctctaacaagatcggcaagccaggctctgcaaattggctaaatttatattgcacactagaccctctgaataagtaagaaggaaattctttcgttggctggaaaagaatctatacagattctatcttaatcatggtctctaaataggccacacaagtccggtgggcaggagccacatcagaggatggggacgggatctcggagtttagagtgtctgtaatgaaacgctacacctgctacctctcaaagtggaattgattggataaaaacttagtacacaagtgtcatcctgtgcttgcttcccagacgttcaaaatctaaagtttaaggtgctattttcctagagcctggaagatgctctgaattcttagtgagataaacagtgacctggcatactggaggtactctatgtgggaaaataagcaaactgggtgggacattaactctggtacactctgtcatctaatattcatttgatgtaacacaaacctactttccatactggccagagtgcaagaggaatttatttacccaccgagggaaaaactgagggcctggtttagctgcaggcatggcttgatcaggggttaaaatgatgttaacaagatttaattcctctcttcctttgtctttaaattgtgacttgacttacctcatattggattatgttggaaccttttttttcctttttgtcttttctttttctttttttttaatacaatttattccatcatggtcaaaagacagacgcagtgttttcagaacttacatcctcctggtttcaaatttcttgtgagtagagggagaatctcttttcctgaaggtgaagcacacaatatattgtgcctccttgtctctgtttgggccacatacccaatccctgaactaatcagtgaggcaaatgcatagatctaagtataaactcgcttagccctggttcacacctcttccctcatagttagagaagttgggagaaggacatcatctccacccaaaatcatggattgaatccagggagaactgattgacccaaagctcattcaaggtgtacgtacaagcaggagcatgtttggacctggtggcaaagagttcaaatttaacacagatattaaagaaaaatgttaaatgtgccctttaaggaaaccacttaaaattcctcctgcacagagcatcataagctgtcttctcttgctgtcttctctttctgcaagcatgatctacaggatgaaggtacatgcaccttccacttcatcttgcagcccctgctcttcatggaaatatctatctatgcctcctacctacattctttgtccctacatctactcttaaacatgccctgatgaagataggaaaattcctctttattatagtaatagctattacttattgctcccttaggatatacctggtatgatgcaaaatcctttacacacacacacaaaaaatcatttaatcttcacagaaactctaggaggccaaatctactgtgtatacagtgagaaaaatgaaagtcaggaggaggatgaagctcaggcaagaacacggagctactaagtggaagaaaagggttccattatacgattcctgcaccagtgttcacaactctacaatgattccattcagttccgttcttcactctgttgaaccgattccacacggaagggcttctccttgctcactgatatggtttagctgtgtccctacccaaatctcatcttgaattgtagcccccataatccccatgtgtcatggaagggacccagtggaaggtaatggaatcatgggggcaggcttttccagtgctgttctcgtgatagtgaataagtctcatgagatatgatggttgtataaagggcagttctgctgcacatgatttcttgcgtgcctccatgtaagacgtgcttttgctcctccttcaccttttgccatgattgtgaggccttcccagccacatagaactgtgagtccattaaaccttttttctttataaattacccaatcttgggtatgtccttataacagcggaagaacagacaaacacattcacttttccttagatctgaggcttccctctctaaccttcattgctatactcctccctcacaactgtaagtatgctttaagctccagagcactggctgggagtccaatgccttctttcacaccattcctcctccctgtgataggaagcttgtcttctagatatgactatgttttctacttgaaaactgccacgtgcttggccccagggaccctacccactgcttgtgttcttcatctctctgcccactgactggggaatcctacgctggcagtattgtacattccttcttatcttccctgccaataagaagctgcctcccacaagataggtgaaccaaaaatttgcagaaaataaatgtaaatgccccatggcactatgcatagaggctcaacatcactgagaataaaagggataccaattaaaatgacaccatgataaccatttactacctattagatcggcaaatattcacaagctgaacaatgtattccgttggtgaagctgtggggaaacacactcatccatcctggtgtgaatgcaaaaatggtaccatccttatgaagagaaaattggcaatgcttaccaaaaaaatctatgtatgtattgatccttcgactcaggatttccacattaagaactctattccaaggagaagttgtcaaaaacatgaacacacaaatgcacaagcctggtcattgtagtactatttgtaatatttgcaaaggatgggagaatacctaaatttccatcaatggaccttatttattttattagacagtgtcttgctctgtagcccaggttggagtgcagtggtgtgatcttgtctcaccgtacctcttaggttcaagtgattcttgtacctcagcctctcgggtagctggaattactgccaccacacctggctaatttttgtagttttttttttttttttcttgaagagatggggtttcaccgtgttggccctgctggtctcaaactcctagcttcaagtgatctgcccacctcagcctcccaaagtgctgggtacaggcataagccaccacattagactagtataataaactatggtacatccacacaatggagtactgtccaaatataaaaaaagaaatgaggaatacaatcaatccttgttattggtggattctacagttgcaaattcacatactagctaaaatttatttgcaactccaaattcaatactgaaggcactttcacagtcaattgtggacaggcatgtgaacagaatggcaaaaatttgagctgcttatgtgcacatttcctggtgaggccacacaaggtgacactctgtcttcttacttaatctctcgtattatacatgtaaatatcctttacacagtctatgaactgccaaattgtttgcattttgtgctttttgatagtgatttaattgtctcaaatggcccccaagtgaagtactgaagtgctgtccaatgtttgtaagcacgagaaggctgtgaaggggctgagtgcagtggctcacgcctgtaatcccagcactttgggaggccgaggcgggtgggtcacctgagtttgggcgttcgagaccagcctgactaacatggagaaaccccatctctactaaaaatacaaaattagccaggcatggtggtgcgtgcctgtaatcccagctactcgggaggctgaggcaggagaattgcttgaatccgggaggcacaggttgcggtgagctgagatcatgccactgtgctccagcctgggaaaaaactgggagactccatctcaaaaaaaaaaaaaaaaaaaaaagttgtgtgtgaagtaccttatggagaaaaaatatgttatataagctttgttcaggcatgagttatagtcccttagttcactcttaatgaattaacattatatattaaatcaggtgtctttagacagaaacacacataaaacaaggttatatgttgattggtgggtgaaaatgttgtcacacaaggctcacaggaacctaactatgtattttccctaggaccaataattcaggatttactaatctagtattcatggatactttacagaacaaaactactatgaataacgagaattacctgtacctctatatatcattaagatgtgatcaccaggatatattaagtaaaaataaggtgcaaaatagtggatatagcatgctactttttccctaaaaaatgaagcagatatgaagagatattcagttttgtgcatatgtgtatataaacaataatagaatgcacaaaaactaaaaaagaagttacctaatacaaatggtatgaaatacgtgaaggggaggtggatataaattacatttctctgaatataatctgttccaaagattttactttttaagcatgtaaatattctacaaaattataaaatcaaattatatgaaacaatctaaaacaattccttcaaacgtaaagccaaacgaagtaaaataactaaactatgtcaagttcgcggcttaacagtgagaaattatgttacactactttaaaatacactaatttgcctgtatctccctgtgggatacagcttaaggttaaaaataactaaagaaattgcaagttattttcagttaacatattgttagttgtgatattgctgctgttactctggaactgttgtacgaatgtggtaggataaagaagtgagtaattacattgatgctacttgggccaaggattttgtcataaggaagcaagacccaagtatagaatcagaaaacttcagtgtaaaccttttgacctaaaatgtgagttgaaggtatcagcatgaatacctgatgcattctctcttttaaaaaaaaaaagaaaaaagttcatttcctaccttagtcaattttaaagacctattaggtgggtgcaaaagtaactgcagtttttgctattactttatttatttatttattttcgagatggagttttgctcttgccacccaggctgtagtacactggcacgatctcggctcactccaaactttgcctcctggattccagcgattctcctgccttgttggccttctgagtaggtgggattacaggcacgtgccaccatgcctggctaatttgtgtatttttagtagagacagggtttcaccatgttggccaggctggtctcgaactcctgacctcagatgatccgcccgcctcagcctcccaaagtgctgagattacaggtgtgagccaccgggcccatccaccgttacttttaacagaaacaatgacatagcccagactgcagtttctaaatactattcgccacttaaagaaactagggatccttggatacaagtagtcaattcctggtctggggcaggaaatacaaaaggtgtgcccagaacatcttattctaccagaaggcaggaggattatcaaagatcactggggtcacatcaaaagaattcaagagaggttcccaagaagatatttctactagcccaaggttgcttaatgttcgtttcaaaaagaatatatgcaataaatgtaaacaactaaatatgttaaaaattaatgagttcaaactaacactttacaaaaaaaagaaacctcaatggtcatctgtggaggtgttaggataccaacttatttttcagaaaactgatgataaagggaaaacataaaaagcttaacgtgcggggtgcagtgttcacgcctgtaatcctagcactttgggaggctgaggcaggcagatcacctgatgacaggagtccaagaccagtctggtcaacatggcgaaaccctgtctctactaaaccctgtctctactaaaaatacaaagaaaaggccagatgcagtggctcacgcctataatcccagcactttgggaggccaaggtgggtggatcatgaggtcaggagattgagaccatcctggctaacacggtgaaaccctgtctctactaaaaatacaaaaaatagccgggcgtggtggcgggtacctgtaatcccagctgctgggaggctgaagcaggagaatggcatgaacctgggaggcggagcttgcagtgagctgagatggtgccactgcactccagcctgggtgacagagtgagactccgtctcaaaaaaaaaaaaaaaaaagtttaacctgattttcctatattaactctactttgaggtaatcaaagagttgatagtgcagagttcttcttttagaaaaatctcagctactaatcaaatgatagagttatactatcacaactttgtacccataaaaaaatggctccaggaaatggtcatcaatagtagctaaaataattaggcgaaaagctaaagaagaactttagaatgggtgaatcaggctgttaccacttatacccatgggtaagtcttaaaaaagagttaaccagatttaacctgttaaccagacaggttcttgctgtgtttcccaggctgatctcaaacttctggcctcaagtgatccctccaccttggcctcccaaagtgctgggattacaggcgtgagtgactgcacccagcccagaactctttaaaatcaaaattgtacagtcagcgttctcagatgtaaacaatagtgtaataaccacattttctggtttctgtatttaacgcttggacatcttagggccttgctgacctcagaaggataggccctttcagggcgagccaatgcttagaaatagtaaatgactcacctgcgagcatgcttttcatatgcaaaccaaccaaccaaccaacccgagctcatatccccagctgtctccttaacgggactctcactctctctgggccactgtccatctgcccatattaccccagggctggtaccatacaactagagacagcccctacaccccagggtttgctgaaattatgccaactagccaatcctaaagcagcttatcctgtctaactcatttcttccagcagaaaccacagtcaagtctcttgcccatgtccttccttctctccctctacatcctacccacccctggggctcccccttaaagtcctgtgtggcatggagtgcctcctgtttctagagaactgtcagtaaaaacttccacgtctgtgtttccttccatacctgattaagacaaatctcacacactcttaaagcaaatagaaatcaactctggcctacttaggtagcaaaagatcatgagaagctcatgcatattaacagcaaagcaggcaatcattactggggctcagaaaaacattaccccaacatgaaggcctcagaagcagcctgtgttttctctgacattctcctgccctcctgtctgtctgtctcattctcccccaaggctagccatagaaaccagaatccctcttccccaaggatgggtcaaagaaactagaatcccttttccccaaagccaaccttaaaacctaaaaatattctatgtaaaaactggccatgctgggtgcactggctcacgcctgtaatcccagcacttgggaggtcaagacgggtggaacacatgaggtcaggagttggagaccagcctggccaacatggtgaaatcccatctgtactaaaaatacaaaaagaaaaaaaaaaaaaaaaccaggcatggtggcgtgcacctgtaatcccaactactcaggaggctgaggcaggagaattgcttgaacccgggagacagagggtgcagtgagccgagattgcaccaaaaaaaaaaactggtcataaacaaattacctcacctaccttgtttgattgtgggtcacaggatcccccaccccgccccacttccagagaggaccctgccccgcatgcagaggaaggaatacatgctcagagagactatgaagaatctagacagacaggccttgctgggtttccccactccatctgtcagcatttgatcagaccctttttgtcccatcctatttctacatggctgtccatacattgttggacataagcatgaaaatagacaatttcccttgactctttgggtcttcattcttagggctcctatatacacacattaagtatatttgtatgccttttctcctatttatcaatctgcttcatagcaatgatttttcagtgaacctagacttagaaaataagcaaaacccagagaggtctagccgtgcaatgcccggccaaggccactttgcaggatattctgtcaagggtgcgatcactgacaaagccactttgggacgctcagagcctgctgggctctcaacaccaccagtgccaccagatgcttgatgctttcatgactaaatcctcaagatgcaaagtcctaggcatgagcttccgattgaccaagcctacattatgtaactaccctccaggtgccaggaggtagcaaaaaaggaatatttgctctctttggcttctgtcaatcaagaaagtacttcctactagatacacaaaggatgcatctcctatatgtaaaaagaatgtttacaccctaagtaacaaaaaaaaaaagtcagaagaccacaagggaagccacagagaaatgcaaagaaggtaagttttaccttgtcacttgcagagcatgtgctaacatcaccaaatatcacagcctaataaatcatgaaattttttaagccaggagagattggtgttaattgattcacgggccatgaaggactagttcggggctgcacatctattcatcatgaggcttccggtgacttttcagagaagccctttaacttctgtggcatctaattcaattaaaggattgagagtttcactgagtagaaactgcagatgaaaacccaatattctttcatttgactcaaaattatattatccatactaagaacatgagagaggtcaaggagcatgagtcatgataaagagcagctcatcgaaatgactctgcaggaacctctgcaggccaacgccattcagaagagccttgactcagaattgtgactttaagagagacagagagagagaaaaaacaacagagtcaaggccaggtgtgtggttcatgcctgtaatctcagcactttaggaggctgaggcaggagaactgcttgaggccaggaatttttttttttttttttgagacagagtctcactctttcacccaggctagagtgcagtggtgcaatcttggctcactgcaacctccgcctcccaggttcaagcaattctcctgcctcagcctcccaagtagctgggattacaggcatgcaccaccacacgtggctaattttttttgtatttagtagagatgaggtttcaccaggctggtcaggctggtcttgaactcctgacctcaggtgatccacccgccttggcctcccaagtgctgggattacaggtgtgagccaccacacccggccaaggccaggaatttgagaccagcctgggcaacagagcaagaccctgcctctacaaaaattttcaaaatagccgagtgttgtggcatgcacctgtactcctagctactcagaaggctgaagcaggaggattacttgagctccagagttccaggctgcagtgagctatgatggcaccactgcactccagccagggctacagagcaagaccctgtctcaaaaaaaaaaaaaaaaagaaaagaaaaaaagaaagaaaagaaaacaattcagttttaaagacaaactaaagctatttttgatgagtaaaataaaattgctcatatttaatagtatctctctttctacaccatgccttcccctaaaagttaccattaaattaatcagtaagagaatgatagtaaatgtcaagtcaatatcggtgtacagatatgggcttgggggtggaaccatccagactagatggcctttcttctcctttgccttttctgaccttgcacttgcctgaacttcctcatctctgcagagcccacagttccaggtctaagctgtgtctgggctgagtggtgcataggatccaggggatgtgaagcctctgattttcccccaatgagctgtgcaaggaagccatctttgctgtgaagtgagagagacccctgagaagaaagggcaggaagacagacccgtggctgtggattcacttcttggactcagccctataaccagtgaccagattcccctacaacgctcaaggaatttgtccttccttcctgttgatcctattatagctttgactgcacacaagcccagagaaacaggggctggggatcagcaggaggaagctgctgctccctcggctctgtccactgtaacgtactcaaggccaggagccacctatcacccaaaacactcagtgtctccccaaatcacgtttctgaaatcggtaaacctttctttatcaaagttatgaatcctgccttgccttattgttagattcaatttttgagtcacttgttatgttctgggaactatatatacattatctcatttaatcatcacaaatactctgtgggtgttgatatttaccctccctcctcccattttgcagatgacataattgagcctcagaaacgaagacaggatttgactccaagctctgtctgtgcatcttgttttaatttattgttttaatcagcactgaactaatcagattctcctctaaatatgcctttttttataacagctttactaaactttaattcacatattaaacaattgtggattttttttgttttgtttgagacagagttttgcccctcttccccagcctggagtgcaacggcacgatcttggctcactgcaacctctgactcctgggttcaagcaattctccagcctcagcctcccactcgtaactgggactacaggcacctgccactatgcccaactaagttttgtatttttagtagagatggagtttcaccatgttggctagactggtctcgaactcctgatctcaggtaatccacccgccttggcctctcaaagtgctgggattacaggcatgagccacagcgcctggctctcactcttttaaagtatgcaattcaatggtttttactatagtcacagaattatgtcatcatccccaatatctaattccagaatgttgtcatcacccctcgaagaaaccctgtgtccattagcagttacttcccattcccctaaccccacttctggcaagcactaatctgttttttgtctctacagagttcatattctgagtatttcacatgattccatttatatgaaatatctgtgtctggctgcttctttttttgtgtctggcttcttttacttagcataatgctttcaaggtccatataagctgtagcatgaatcagtacttaaatcctttttagggctaagtaatattccagtgtatggatacaccacattttgtttatttattcatcaatggataaacactcgagttgcttccacttttttttgctaacatgggtaatgtgccgtgaacattcatgtacaagtttttacatggacatatgttttcaatttttgtgggtatatatctatgagtggaatttctgggttatatggcaactctatatttaacttttaaggaactgccaaagtggtttttacaatatctgcatcattttatgttctcaccagcaacgtatgagggttctaagtttcccacatcctttcccacattatcattttccaacactgtcttgtttattatagccatcctggcaggtatgaagtggtatcttattgtgattttgaattgcatttccccaatgacttaagatattgagcatcttttcatgtgcttactggccatttgtgtatcttctttggagaaatgtctattcaaattattttcccattttcaactgggttatttgtcttttactgttgagttataggagtttttaattccagacacaaatcccttatcaggtatattacttgcaaatatatttttccatcttgtgagctgtcttttaactttcttgatagtttaactttgaaacgtatacatttttaattttaattaagtcaaattcatctggatttttgttgttgttcatacttttgctgtcatatctaaaaaactattgccttatccaaggccctgaagatttattcccatattttcttctaagagttttgtaatttaactcttaggtttaggtctataatttattttgagttagtttttgcacatattgttagggaggaatctaacttctttcttttgcatatggatatccagttgtcccagcaccatttgctgaaaagacttctttttttttctttgagttatcttggtacccttgtagaaaatgtaagggttaatttctagactctcagttttcttccatggatctatatatctatccttatgccaataccacactgccttgattactgtagctttgtagtaaattttaaaaggaggaagcatgaatcttccaagtcttttttcctcaagaattttttggctattctgggtcccttgcactttcctatcaattttaggaggagtttgtcaaattctgctgggattttaggattgctcagaacatgtagatcagttaggaaatattgtcatcttaagtctcccagtcattgaacatgagatatatttctatttatttaggtctcttttatttcaatgatgtttgtagttttcactgtatacgttttgtacttcccttattaaatttaaccctgagttttttttattatttttgatgcttttgtaaatggaattgttttcttcctttccttttggattgttcattgctagtatatggaaacacaatcggtttttgtatattgttcttatatcctgcaaccttgctgaactcactgattagttctaatagattttcatacgtgaattcttcaggattccctgtctacatacatgagacattcctgggtggagaccaaaattcctggatggtctcttcagatccaaacatcccattatttgtaagcatagccctctcttaccctgttcaaatggacttttttgcttttgttgatgttttattcatttttaccacccagtattcatttcctctcttctggaaatagtattttatttttttccaggaatacacgctctccttctcactctgtccatagtcttcagagaatatagctccaggaatgggcatgtgatataagcctagccatcatgtctatctggctactattagttcaggtctgggcacatggtacaattaggaccaatgggttgcaatctcaggactttgaaaagcataccacaagatcatatagttgtcttttctggcagacttattagagccaacacagagaaaaacagagaagagagatggagagagattgggtctgattcttcacttcagcccagaatcacattacactgggaactcagtctagcccttgactagttcagtgtgtgaaccaataaactctctttatgcattaggcagttatctatcacccacattgatgttatttcagaccatgtgcgaggcattgctactcataagagaccagtattttccctttgcaactcctaaaggctttatgcttaagtgaattgtctagtgattaaaggatagcaaatactttaaaaaaattatgttctctgtttccattctatgaaggaagcccaagtcaagaaaactgattttcattaagggtgtacatatttgaattatttagctctacatttggtaatgcacttggcttgaatttcaagtacagtccctctgatggctaatttaacataaaacacagtccaggcttccttttttttccagcagtttttgctaatggtgactttgccatcagagggtctaggaccatgcagactcagctctatagtattttttaaatgaatccccttagatggaaagagccagcttatatttaccgagataaacttttagagttttgcattatatccaacagtgttaagcaagaaaaaaaaaaaaaccttccaataatcagttccacgagagaggctgttgacttttattcgtttctatagctcatgaacccaaccttgaattccagagagagaaagctaccctcagcttgtgatttaacaagttctgcagttcacgaggaactgaagaggtttttagctctggataccatccctctggctccattcttttagctgatagaaaacaggatattactctagggaaggaggttcttttatctcccagctgtagctttctttagagaaaggggattgtggaagtcaaaacatcgtccttccctgaatagacgagattgatttattagttggcatctttataatcctttcctaagtaaaggcaagaaacagtgcttaccagcgtggatttaaagctcctcatatatggaccaaaaatttgccactcccactcactagaatgtgtccatggaaaaggtcctgaaccagtctgagccttagactccttttctgtaaaatgcagttgataataaagcctacctcatgggaccgatttgagaactgcatgtgataatgatgtaaaatgcacttagctcatgatgtctaataagtgttccttaaatatgttatttttgtgactgtttaatcctcaataagaagagtaaatatcagatatccctgcctccctctaagaaggcacattcccagttcattttcaagactcaagtggccaagacaagcaaactttctagatgtgactgaggctgaacaaagctggcattatctactcctggtctttccagatctgtctgtttttatcccaccaggtccactcgaagcctctcttctgaaatttgaccagaaatgacaaagaatcatgagttggttccactgagcatccacccagaatgatgcctcccaagctaatggcatttttcaaccatcacaatggagtgaatgatgtggatattagcacccctacttacagtcattgatgaatctgctcttggcagtcagagcaccgaagtgtgactgcaacaatggtgagggggagagttagaagggaagataaatgagctcattgtgcctatgtattttggaggccaaggctactatcaggtgttccaagaaatgggatacaaaagaaatgagttttgtcacctaaaaagagaaaaggattcaaccaaggcaaattctgaaaagaaagaacagccagtgtcacccaatttctacctcttccaatcatggcatttatctattttatgtctctagccaaggaaaaatgcaatgcctcctttacaggtttgttctgctggagatagtgattattaaagcaatttgttagaggcagattttgcgtacatattaaagcaagataatcgtattggagacgcttgcctgaagcagggattcagctggaatggccattgcacacaagtctgtttttcagaactgggtaatgatgagcacatttagtgactaagatgcatggcctgatttaatgggatttcccccaaaatatatatggtaatggaagtaagcctgcttaaatagtgggtacatttggaatcctgctttaagagaatacaacttaccaattagatcacagcctattgtaggggagaaaaattaaatctgcccctgaagtttatgtattcattcaacaaatatttatctaacacctactctgcacaaggggctggaaattaacatgtgaagaataagaaagacatagtgtctggttttgtaaggtttccgtgctggtgaaggagatcaaacatagcattatacagttagatactcaattacaatcatgacaaacgcttcaaaggataactacagggcactttgcatgtgagtgtcaggggaactcactctaatccagacaatcagaggttttcttgaggaagtagcatttaagctaaacactaacagatgagaaccacttaacaaatggggtggagaatgaaaatgtgttccaggcaaagactatggcatatgccaaggctctaagtcaggagcaacagtgtaacctggtgtggttggagctaggagagaagaggagaagcgaatgaaggtgctggaaaggttgttagaagcctttgcacatgctgcactgttgcctggagcacaacacagtgctgggacatgcatgcagggccatggtcaggacttggctctggcctaagaacaatggggagccactgagggaccctaagcgagtggcctggcagtagtttagcatttttgaaaagtcactctggaccaggggtggtggcttacaactgtaatcctagcactttggaggctgaggtgggcagatcacgaggtcaggagttcgagaccagcctggccaacatgatgaaagcccatctctactaaaaaaaatacaaaattagctgggtgtggtggcacgcaactgtaatcccagctacttgagaggctgagacaggagaattgcttgaacctgggagacggaggttgcagtgagccgagatcataacactgcactctagcctgggagagagagtaagactccatctcaaaaaaaaaaaaagtacttatattaattaattcagttagtcctacaaacaaccgctgcaatagataccatcattatggtcattttacagataagaaaattgagattcgcagagccaggaccaccccagcaaatagcacagttgggattcaaaaccaagcagtttgagtgggtattaaaaaaaaacaagtttccattcaacttatgaagcaacaacaggcagaaatagaagttgaaatttatgttaatcaccttctgtgattctacactctcaatcaattcagatagagaaatccaagttgactgcacagaggcacggctctctgaaaaatttaacactgtgccacgcttacgaagaatgaaacaggctggatgtcggttccacagcatcccaaatgttcccacccttcgcctcatgacaaaggaacagcaacttcaatttatgtgccaacggatcacaccccagcattccaagggactttgctggggaggaagcgcagtggtttaatggtacagcatgctgtgctgggctaaggatagaaagtagacacagcagtgtggcctccagcttgcatttacagaagggagttcagctgggtgtctggtcaagctggcccagcccagactgggaaaggctgaatgtctgaaagtctcttttggagaagtacaatggaatgctaccaacctgcaaactttcaagttccatggaaaccaactgtctcatgcaggatgtttttctcacaatcactgcaaggatgacaatgggttgtgtaaggtggcacttggagaattaaacttttcatgccattgtttggtacaaagattattggatattgacatgtaatgatgctgtgtgctgtcactcatttaacacctgcttccccagtggactccatgagggcaagagttcagtctgtctgactcaatgctacagcacttagcatgatgcctagaataataataataatgaagaggagaaggagaaagatgctgaagaggaagaagaggaaaaagaaaaaggagaaaggaagataacagttgacatatattacgtaattatgataagcccattatagtctaaaagccttccatgaattgtcattgaattctcacaagaatcctacaagatggattttattactgttacagtttacaaatgaggaaactgaggcatagggaactgcagtaacaggctgactctgctactaagtggtagagacaggattcgaacccatacactgacatcagagtctgtgctcctaaccttatacagtggtgcccattgtaaagagaggagataggtcagtacttgtggaataaataaataagtgtttcagaaacgctcacagtagtaggggacgtggtcaggaagtaaatgagtaccttcctagaaggatatattggaatccctagggagtttttttttcaaactacccacctgtttcttagctactcccacccgctactgctggatgaaaagccttacggtggccagtcacctttagtgattggaagtgtgttttctcactcaagcgtatagggaagaaaaagaaaaacaattttggaaattattgttctagaccagtggttcccaaacctgcccacaaactagacttataaaaaccagataatttacaaaaatactaatgcctgtgccccaccttcaatggattaaattagaactgctaggggtggggccttgacactggtatttcttttttttttgagaccgtgtctcgctctgttgccaagctagaatgcagcggcatgatctcagcttactgcaacctccacctcccacattcaagcgattctcctgcctcagcctcccgagtagctgggactacaggcacccgccaccacacccaactaatttttgtatttttagtagagacagggtttcaccaggttggccaggatggtctcgatctcttgacctcatgatccacctgcctcggtctcccaaagtgctgggattacaggtgtgagacaccaggcccggctgaaattggtatttcttaaaagccaccaagggaattgaatatatggtcaagactgagaagcactaatccactctcctcatcaaaaagcaaccaggggatgctccaggcccacctgattccccttccttagatgttagcttagaggtacagatatcacaggtgtttggtatttaaaagtttaattcaattcaactattatttcatgaacacctcctttttgggtttaattttgggggtacatagtaggtgtatatacttatagggtataggggatattttgatacaagcatacaatgtgtaataatcacatcctcaagcatttatcatttgtgttacaaacaatccaattaggttctatatttttatttttaatgaggtggagtctcactgtgtcacccaggctggactacagtggcgcgatctcggcttactgcaacctctgcctcccgggttcgagcgattcttctgcctcagcctcctgaatagctgggactacaggcgcatgccaccacacccagcaattttttttttttttgtattttttgtagagacggggcttcaccatgctggtcaggatggtctcaatctcttgaccttgtgatctgcctaccttagcctcccaaagtgctgggattacaggcatgagccactgcgctcggccaagttctttgtttttaaatgtacaattaaattactattgtagttactctgttgtcctatcaaatattagatcttattctttttttgatacccattaaccatccccacatcccccctgttttgaaaagatgttttagtctgctctcattttgctaataaagacatatccaagactgggtaatttataaaggaaagaggtttaatgaactcacagttccacatggctggggaggcctcacaatcacggtggaaagtggaggaggaacaaaggcacatcttatatagtggcaggcaagagagcatgtgcaggggaactgccctttataaaaccatcagatctcatgagacttattcactatcacgagaacagcactggaaaagcccctccccatgattcagttaccttccactggtccctcctgtgacacatgggaattatgggaactacaattcaagatgggatttgagtggggacacaaccaaaccatatcaagagataaaaaggcacaaagcacaactttgatcttttatggccccaaagcttaataatgggataatacaagcatagagacgagtatataacatagttacaatatgtaagagaatatggcagagatagataggaaggaggaggaccgacaggaataagggccctaatgaaaagtggaagagtctctctgggcagctaagaaaaatgccatggaagtacagagaaaatggatgcagaagaacaaagcaaagatggaatttcttttcttttttaaaattttttgagttaattgtagattcacatgcagttgtaagaaatacagagaaatcccatatatccttcaccactttttcccaatggtaacaattcgcataactatagtctgtatctcatctcttttctttttgataaaaggctctgagaatgagcagatttcaaaaaaaatttaactatcctatcagataatttaattatgagcatgaatcaacaatgtatttcaaatttgtggcaaaggcaagagactttgctgaccttggaagggacattttctggaaaaagagaagaatgagataatcactgttagactgaatacatgtaaaaagaatgcctggttaagaagatcattagacccttgactgacagtcagctaagtagctgggtaggtagtttcccagaagaggtcataatctcattaaagtttgatataaaactgcttaagcattttatcacaaatcttaatttccttcctagtaggaggttatgaattacagcatgaaaaaacttctgtatcaaaccagatttgggacagtttttctttaccataagccagggatctgagtgaaatgttgagtacccaccttgaattttggaaggaataaacacaataccaagaactgaggccgggagcagtggctcacacctgtaatcatagcactttgggaggctgaggcaggcagatcacctgaggtcaggagttcgagaccatcgtgaccaacatggagaaaccctgtctctactaaaaatacaaaattaggcgggcatggtggcacatgtctgtaatcccagctactcaggagactgaggcaggagaatcccttgaacccaataggcggaggttgtggtgagccgagatggcaccactgaactccagcctaggcaacaagagcgaaactccatctcaaaaaaaaaaaaaaaaaaaaaaagagttgaggccctggggaagatgacccaagaggaaacccataggagaccattcagtaacatggaaactttagtttctgtgtgacatacatgacttgatgtttgttatatattttttccaagttagactgtgaatcctctataatgtaagcttccaggacacggatctcatttgtgatactgtttccccccaccttgaacattatcaagcacataataggctcacaatgcaataaatattgactgaatgaatgaatttctaaacacttaaataaccaggaacactgcctttcctacatttcaagcatgtcaaaggtggggatagttaagtcatgactgtatttcatgaattttcatgaattgatattaggggaacacatgaaggagtgtgttgatatacaccaaggctgaaactgtaagaaaattttcagcctcatcttggccaagaacctctacccagaaacaggggacccaggaatcactcaagaaagccttcattgtaattatgaagataaagaacaaatcagtggttgctgggaattgaggaatgggatgtgattacaaagggatagcataagagaatttttgggggaggagaagctactctgtatcttaactgtggtagtggttacacaaatctatatatctattaaaattcacagaactatacacaataagtcaatcatttaaaaaatgttgccactaaaaatcccattgaatggacaccttgtgttgagggaggtgcctgccagccaacgcactgttgcttccttctcttggaccagcaccaccccccacacgccacctttatgtatgatgaggtctccaggaatgatacttatactgtgagactccactcccatctctatccttcagggtgactgataatgagtagacagcaaactagaccaagtaggtgtctctctcagatatttaaaattgggactgtagctataagtaaatctctaagagttgctggaatggtaacaataatacctaaaattgtgagacagccatatcgtatttcatagatatcaaagttgagatagatggtttacagaatgagagagaaggatgtaagcctaccaaaagaagtgacgataagggaaataagagagagactgagaatcagacatgttggctgactgatttaatgggtttccagtttctaattcctcttctcaaggtctatctactttcttccccttggtttcaatgagctaccctacacccttatgatagtccttgtgtatgcttctgtttaatcaagctcagttatcctgtttgtaaaaacatagactctgaattaatctatgggcctttaaacactagttcaagcaccatcaaatagtcagaatttgggcaactcaacctcttgatgcctccgttttctcatctttaaaaggacaatagtaccttttatacaattgtggggattaaatgagtccatataaagttcttagagcaatgcttgacacataatatgaatccagatatgctgctattattatgactaacacagctttatcagagtctgtctatactctcaatatcatttcatagcaggaaatagctataattatcaatattttctgaggtgagagaacaaaaaacaggaaaccatctcattcattataagaaccccaagacttcccccaaacatgaaaaatgcctcttgaaatgattattctaatctaatgcaaaattatgaacatgaggaattttattgtatttctttaaaatctggtaagatttcctgtgaaattataccatggtatcaaaatgaaatttaagacctttcaccaagtttggtcctattctctctgtggcatgaacacagtggggagttgtggatgatctctttcatctgcattgtaacattgtaattttagagtttataaaacaccttcttggattctattccattttgattttttctttttttagatggagtctcactctatcaccaggctggagtgcagtggcacaatctcggctcactgcaacctccacctccctggttaaactgattctcctgcctcagcctcccaagtagctgggactacaagtgcacaccaacacgcccagctaatttttgtatttttagtagagacagggtttcaccatcttggccaggatggtctcgatttcttgacctcgtgatctgcccgccttggcctcccaaagtgctgggattacaggcatgtcattttgatctttatgacaactctctgaggcaggtattatcatcaaaaatttacagatgaggaaataaaagctcagagagacaccaacatccatccagctacttagtttcatagctagaactgaggccttctggctccaagaattgggcttcttcctaacaatcatattgatgcctaccagattaacagctctgcagatgaagaccagcctgatataattattttgcccacttctcagtttctactaccaactgttatatttcagacctatatattaggttctcacataagtgcagtgagtttagcagaccatcctcactgtatagactgtgaaaccaggtcttcagtaattcaagtccaaggtcaccctttgggtatgttgactagtaattatataaacctggaaaatcaaccaaatatctcttgacttcaaatccagtactttcccccactttatggcactatctctctgatatgtgtttattcttagcgctagaacttcaaatttccaaacaggcctgggtgatagagacatgtgtttcttatggtcaaacaaattgctagagctaagacagaaacacacttgcttttccaagtggataggggcagaatgaaaactaagttcaattgcttgatttgtgcaaatatcacacaagaatacggtagacctatgtattaggttggtgcaaacagaattgcggatttcgccctaacttttaatggccaaaaaacgcaatgactttgcgccatcccaatattatatttcaacataggtgtccaagatagagtgttaagttggtggggtgtgcggtggaggaagcacaacgtaaaacagcttagctgttagcttcaaccataagggggaaagtaacaaacttaaataggttatgtaatgagttgaaatatttctctagaaagatgtcatacattgcaaaataggtcagagctggtcttcggcctaaaagagcagagtttctttgttctttgtgtggttgagggtggaaatccttctataacagatccagctaccccgctactgtggtttgccttaagaaaacaattgcaagaaaggtgggaagtgagagagaatagtatgtgtgtgggggagtggggcggaggggagggtgtgcctgtgtatgtgtatctgtatacgtacagctaaattgtgagatctatgtattaaagagttttggaaacctaggacctgcacctagagacaccacctattcaaacaatagtttgcgcaaatgggaaaataaactgggtaactgggtttggcagtagtataatcccaggtcatggctgattttatgcaagagtttatgaattataccagcacagctggagacctgtgtttcaagagcaatcatctgggccgggcacagtggctcatgcctgtaatcccagcactttgggaggccaaggtgggcagatcacaaggtcaggagatcgagaccatcctggctaacacactgaaaccctgtctctactaaaaatacaaaaaattagccaggcatggtggtttgcacctgtagtcccagctactcgggaggctgacgcaggaaaatgttgtgaacccgggagatggagctagcattgagccaagatagagccacggcactccagcctgggcgacagagcaagactccatctcaaaaaacaataaataaataaataaataaataaataaataaataaataaataataaataaaattaaaaaaataaaaaagagcaaccatctgaaaataaaaactaccaaatccaaaaacaacattattcctcagctgaggaaggtttttgtttttatctctctataattatggtaagcagacccgcctccttaaatagtagaatcacccctgtattatgagaagttaccataggagaatagactcaggacaggaaaaaagatattctcacagtataaggtttcagagatatttaatttagttaataaagggaatgtgacctcacttctatttctgcctaggacagtggcttatatcacactaaatcttctgccaataataactataaaatctgggtgaaaaaaaaataaggctgcttgaaaccactgaagggcaaccaaggcagccagaagtggataaggcaagatcatgaagagataaggatgctattgaggtgagccctgtgttattatccagtgtgtttccctttgaggcatttgccaagtcatcgtgcatggcattgaggccaaatagaaatcagcaacctggaacttgcagctgtcttagcaatgaacttcaagactcccaaagcatccagaacatgaaggtctaagttttcagagaaaaaaagagaatttctgaaaagtgagcctgaaattctacatacaattctctcccaagggatttgggagcttcggcgatgtacatacacatcaagaaaaatgctgagaacacaggaagaaagcatgagccaagaagctacaaagctagatttgcagagataaactttggaggtcaaaggataccaaagataatggacgcttgttagggagaagtgggagagggtggtggtgcagggcagattttgagttgaaacgtcaatgggcattgccctaggattaggggttacactttaggagtatgtacaagctggaaatacagccaatacttacaaaaactgaagcctaagcttctgctaaagcaaggtaatctgctcatactctttctgcctgccagaaaataaaatatatcccctgtagaggaagatatattgtccagagcctctactatctttcatacaaaatatccagcattctacaaaaaaaaaaaaaaaaaattatcaggcatcctgggaaacagcagaatgactaaaaaccctaagaaaacacaaacaatagaaactagcctggaaagaatccagatattgagttatcatacatggattttaaaataaccattattattatttccaaaaacagagaaagagatcgtgaattataggattagaacaccgaagagagaaaaaaggaaatagaaattttaaaattgaaaaacatcaatactcaaatgtagaactcagtaatgatttttagagaaggtaagatagagcaaagaagattaatgaaataacagataactaagtagaacctatccagattgaggcatggggagagcgggaggaatgaaaaccagataagggtgtgacccaagggacatgatagcaaagtttaatgaatgtgcaataagaatctcaaaacgagaaaacagaaaagatagaaaagaaatatttaaagagataaggactggaatttttccaaaactgatggaagatcaatccacagatttaagaagctctataaatactgagagaaaatgaacacaaaataaaatatctgggtaagctgttgcaggccaaagacatagaaaaatcagcaaagagcagccagaagagagaaagggttatattattttccaagggataccaataagactaacagcagatttctcaattaaaatgacagaaactaggaggcagtgctataatattcttaaaaggctgatagaaaataactatcaaccgcaagttctatacacgacatgaaaatgaaggtagaataaatataattttacataaataaaaactaaaatatttaattacagcagactggtactagagaaatattaaaggatgttaagtaaaaataaacacagaagcagtgatcctacagggaaaaaaaagcagtacagtaaggaataaaggcaatggaaaggacaaatatgtaagtaaatccaaatgaatattgactaccaaaacatccacaatttgtctggcagtgttcactatatttttagaattgaaatatataacaatgatgacataaaaaataggagatgttaaataaaagttaactcctgtaacattctagctttgtctgggaaataagaaaaaattgttacatcaagtagaccttaataaggcaatgacgcatattgtaatatctactgaaacccctaagaggaaaataagagaatgtatatgaacatgttaaaaactagccaaaatggaataaaaaataatttattaatccaaaagaaaatacaaacgaaagtatgatgacacattttaccataaatatttcggtaactagcaataaatgttaatggattaagtaatccaattaaaagagattttcaacctagataaaaataacaagctatgggttttatccaagatggccaaataggaacagctccagtctacagctcccagcatgagcgacgcagaagatgggtgatttctgtatttccaactgaggtaccgggttcatctcactggggcttgtcagacagtgggcgcaggacagtgggtgccgcccactgagtgtgagccgaagcagggcgagacatcgcctcacccgggaagcacaaggggtcaaggaattccctttcctagccaagcaaagctgtgacagaaggcacctggaaaattgggtcactcccaccctaatactatgcttttccaatggtcttagcaaatggcacaccaggacattatatcccgtgcctggctcggagggtcccacacccacggagcctcactcattgctagcacagcagtctgagatcaaactgcaaggcggcagctgggggaggggtgcccgccattgctgaggcttgagtaggtaaacaaagcggccgggaggctcgaactgggtggagcccaccgcagctcaaggagacctgcctgcctctgtagactccacctctgggggcagggcatagccgaacaaaaggcagcagaaacctctgcagacttaaatgtccctgtctgacagctttgaagagagcagtggttcttccagcacggagttggagatctgagaacggacagcctgcctcctcaagagggtccctgacccccgagtagcctaactgggaggcaccccccagtaggggcagactgacacctcacatggccgggtacccgtctgagacaaaacttccagaggaatgatcagacagcaacattttctgttcagcaatattcgctactctgcagcctccgctgctgatacccaggcaaacaggttctggagtggacctccggcaaactccaacagacctgcagctgaggatcctgactgttagaagtaaaactaacaaacagaaaggtcatccacaccaaaaccccatctgtacatcaccattaacaaagaccaatagtagataaaaccacaaagatggggaaaaaaacagagcagaaaaactgaaaatactaaaaatcagagcgcctctcctcctccaaagcaatgcagctcctcaccagcaacggaacaaagctggtgttttgttttgcatgactttgatgagctgagagaagaaggcttcagatgatcaaacttctcccagctaaggaggaagtttgaacccatggcaaagaagttaaaaaccttgaaaaaagattagacaaatcgctaactagaataaccaatgcagagaagtccttaaaggacctgatggagctgaaaaccatgacatgagaactacgtgacgaatgcacaagcttcagtagccaattcgatcaactggaagaaagggtatcagtgatggaagatcaaatgaatgaaatgaggcgagaagagaagtttagagaaaaaagaataaaaagaaacgaacaaagcctccaagaaatacgggactatgtgaaaagaccaaagctacgtctgattggtatacctgaaagtgaccgggagaatggaaccaagctggaaaacactctgcaggatattctccaggagaacttccccaacctagcaaggcaggccaacattcaaattcaggaaatacagagaatgccacaaagatactcctcgagaagagcaactccaagacacataattgtcagattcaccaaagttgaaatgaggaaaaaatgttaggggcagccagaccgaaatgttgggttaccacaaagggaagcccatcacactaacagctgatctcttggcagaaactgtgcaagccagaagagagtgggggccaatattcaatattcttaaagaaaagaattttcaacccagaatttcatatccagccaaacgaagcttcataagtgaaggagaaataaaatactttacagacaagcaaatgctgagagattttgtcacaccagccctgccccacaagagaaggaagcactaaacatggaaaggaataactggtaccagccactgcaaaaacatgccaaattgtaaagaccatcgaggctacgaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacaaaaaaggcaggggttgcaatcctagtctctgatacaatggactttaaaccaacaaagatcaaaagagacaaagaaggctattacataatggtaaagggatcaattcaacaagaagagctaactatcctaaatatatatgcacccaatacaggagcacccagattcataaagcaagtcctcagagacctacaaagagacttagcctcccacacaataataacaggagactttaacaccacactgtcaacattagacagatcaatgagacacaaagttgacaaggatatccaggaattgaactcagctctgcaccaagcgaacctaatagacatctacagaactctccaccccaaatcaacagaatatacattcttctcagcaccacaccacacttattccaaaattgaccacacagttggaagtaaagcactcctcagcaaatgtaaaagaacagaaattataacaaactatctctcagaccacagtgcaatcaaactagaactcaggattaagaaactcattcaaaaccactcaactacatggaaactgaacaacctgctcctgaatgactactgggtacataatgaaatgaaggcagaaataaagatgttctttgaaaccaataagaacaaagacaccacataccagaatctctgggacacattcaaagcagtgtgtagagggaaatttatagcactaaatgcccacaagagaaagcaggacagatctaaaattgacaccctaacatcacaattaaaagaactagagaagcaagaacaaacacattcaaaagctagcagaaggcaagaaataactaagatcatagcagaactgaaggagatagagacacaaaaaacccttcaaaaaatcaatgaatccaggagctggttttttgaacagatcaacaaaattgatagactgctagaaagactaatgaagaagaaaagagagaagaatcaaataagcgcagtaaaaaatgataaaggggatatcaccaccaatcccacagaaatacaaactaccatcagagaatactataaacacctctatgcaaataaactagaaaatctagaagaaattgacaaattccttgacacatacaccctcccaagactaaaccaggaagaagttgaatctctgaatagaccaataacaggctctgaaattgaggcaataattaatagcctaccaaccaaaaaaagtccaggaccagacggattcacagccgaattctaccagaggtacaaggaagagctggtaccattccttctgaaactattccaatcaatagaaaaagagggaatcctccctaactcattttatgaggccagcatcatcctgatagcaaagcctggcaaagacacaacaaaaaaagagaattttagaccaatatccctgatgaacatcgatgcaaaaatcctcaataaaatactggcaaactgaatccagcagcacatcaaaaagcttatctaccatgatcaagtgggcttcatccctgggatgcaaggcttgttcaacatacgcaaatcaataaatgtaatccagcatataaacagaaccaaagacaaaaaccacacgattatctcaataaatgcagaaaaggcctttgacaaaattcaacagcccttcatgctaaaaactctcaataaattaggtattgatgggacgtatcccaaaataataagagctatttatgacaaacccacagccaatatcatactgaatgggcaaaaactggaagcatttcctttgaaaactggcacaagacagggacgccctctctcaccactcctattcaacatagtgttggaagttctggccaggggaatcaggcaggagaaagaaataaagggtattcaattaggaaaagaggaagtcaaattgtccctgtttgcagatgacatgattgtgtatctagaaaaccccatcgtctcagcccaaaatctctttaagctgataagcaacttcagcaaagtctcaggatacaaaatcaatgtgcaaaaatcacaagcattcttatacaccaataacagacaaacagagagccaaatcatgagtgaaaccccatccaaaactgcttcaaagagaatgaaatacctaggaatccaacttacaagggatgtgaaggacctgttcaaggagaaccacaaaccactgctcaacaaaataaaagaggacacaaacaaatggaggaacattccgtgctcatggataggaagaatcaatatcgtgaaaatggccatactgcccaaggtaatttataggttcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctactgacttcaaactatactataaggctacagtaaccaaaacagcgtggtactggtaccaaaacagagatatagaccaatggaacagaacagagccctcagaaataataccacacatctacaactatctgatctttgacaaacttgacaaaaacaagaaatggggaaaggattccctattcaacaaatggtgctgggaaaactggctagccatatgtagaaagctgaaactggatcccttccttacaccttatacaaaaattaattcaagatggattaaagacttaaatgttagacctaaaaccataaaagccctagaagaaaacctaggcaataccattcaggacataggcatgggcaaggacttcatgtctaaaacaccaaaagcaatggcaacaaaagccaaaattgacaaatgggatctaattaaactaaggagcttctgcacagcaaaagaaactaccatcagagcgaacaggcaacctacagaatgggagaaaatttttgcaatctactcatctgacaaagggctaatatccagaatctacaaagaactcaaacaaatttacaagacaaaaatgaacaacccaatcaacaagtggcaaaggatatgaacagacacttctcaaaagaagacatttatgcagctaaaagacaaatgaaaaaatgctcatcatcactggccatcagaggaatgcaaatcaaaccacaatgagataccatctcacaccagttagaatggcaatcagtaaaaagtcaagaaacaacaggtgctggagaggatgtggagaaataggaacacttttacacagttggtgggactgtaaactagttcaaccattgtggaagacagtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagtggattaagaaaatatggcacatatacaccatggaatactatgcagccacaaaaaaggatgagttcatatcctttgtagggacatggatgaagctggaaaccatcattctcagcaaactatcgcaaggacaaaaaaccaaacagctcatggtctcactcataggtgggaattgaacaatgagaacacttggacacaggaaggggaacatcacataccggggcctgttgtggggttgggggaggagggaggaatagcattaggagatttacctaatgtaaatgacgagttaatgggtgcaacacaccaacatggaacatgtacacatatgtaacaaacctgcacgttgtgcacatgtagcctagaacttaaagtataataaaaaaataaaataaaataaaataaaataaaataaaataaataactggctatatgtggtttatatgacactgaacatcaatataaaaatatagaaaagttgaaagtaaaaggatggtaagaaatacccaaggacatagcaaagccaatgtcattatactaatatcaagcaaagtagactttactgaaataaatataatagagataaagatctgtataagaatatgtatagaccaggtgtggtgggtcacacctgtaatcccagcactttgggaggctgacgtgggaggattgtttgaggtcaggagttcaagacctgcctgagcaacatagtgagaccccatgtccacaaaaatttaaaaattagccagttgtagtggcatgtgcctgtggccccatgtactcaggaagctgaggtgggaggattgctccagcccaggtcgttgagattgcagtgagctgtgatcatgccactgcactccagcctgggaaagaaagaaaagaaagaaaagaaagaaagaaagaaagaaagagagagagagagagagagagagaaagaaagaaagaaagaaagaaagaaagaaagaaagaaagaaagaaagaaagagaaaagaatatttaatagaagcatttttcacaaatgcttccccaaactggagcttacccaattatccagcagcataataaataaataagcatattgtaatagtcataagatggaatattacatagcaattagaatgagcaaacttctgttagacacacaattacagataaatactgtagataaaatgttgaacaaaagaagacaaaaatgaaagggtgcatgaaatatgactccatttatcaaaaatccaaaataggaaaagctaatgaatggtggcacaagtcaaaataatggtgatctttgaggaagatgatggagaaggaacatggaaatcttctaggaaatattttccgtattgatctgagtggtgtgtccacttctgaatatttgtcaagcagtacaattatgatttgtgtacgtttatgagtatatgttttacttcaataaaatgctttagaaaaaagataaatttaatcccatttgctacaccaaactactgaaagagggtatatgatctgtttatgataattttaatcattaatagtaacagtagatacttaactagtccttctggaaagaaaaataccacatgttctcactcacatgatagagctaaaaaatttgatctcatagagatagaaggtaaaataatagatactggagtgggaagtatgtgaaggtgggagggggaaatgaagagagattggtgaataggtacaaaccgagagttagatagaagaaataagttctaatgtttgatagctactagggtgatcattgttagcaactgtatattgcatatttgaaagtagctggaagaagacttgaaatgttaccaatgcatataaatgaaaaatactcaaagtaacgaatatcccaaataccctggcttgatcactacacattctatatgtgtgaaagatactcacttatacccaataaatatgtaaaatattatttattaatacaatttaaaactagtcctgcatgtaagtattgtaattatgttaacttaatacttataaaaatctgttaagtaggttctattattatccccatttcacagataaaggaatggaagaagagggagtgtcttagtctattttctgctgctatagcagaatatcacaggctagaacatttatgaagaacagaagtgtattttgtttatggttctagaggatgggaagtccaaggacatggcacctgcatctggtaagatacatcttgtggcagaagggtggaaagcagaaagtggaaagcagaagcaagcactcaacacagagaaaaaataacagccagacttacccttttgttaggagcccactcccaaaatcattaacctactctggtgataatgacattaatctgctcatgagggtaaagccctaacggcctaaaggccctcaccttctaaaggccccacctcttaatactgttaaaaatatgattaagtttccaacaaatgaacttttgcaggatacattcacactatagtagggaggttaagtaacttgccctaggagacacacagttaatgggtagcacactctctccttctcccttccccctccccctctttccttttttcctctcctccctgccatttctctgttgcaccttagaatctcttggggagatttgtaaaaatttcaatgtctagactgcagcctaagccaattaaatcagaatctctagagtggaatacaggaaactggttggttggttgtttttttaaagaaaaacaattccttgataaatgtatgtctgattatcattttaaggatgtgagggttaaagttcaacggggttagataacaacaaatgagtagagggaaattaagaagtggggaaatcagaatttaaaccccaatgtactgaggtctagaatttgagtaccattcctccttccaatgatcaggaacttttgattttcttccagatacccaatcctccacattaaaggtacagccccaacatctgggggtggagagaggtataggtctggcatttatccaggatttttagcttccttcatcagaaaacacctgaagataggcagtcacctatggcaagaaacaaataccaaagatggaactatggggataagacataaataagttttaccttagggatcctgttccagtatgatgtccatgcttcaaacttttataaccaggtccttcaatgactaaacttctttcataagtgtccaaagtaggcttacctttctccttcctgtctccagggtaattaagtgactaaattttaccgaggctacaaaactcacattgaaagaaaattgggtaacactcaagtgggaaaaggagaacttttctaacataaaaatattataattgtgcaatattggccataaaacatgctgagaaataattgtttgaaaattatcattatctaaatctcagtatgggagagataaaagagaacaatgttcacacgagctttctcaattaagggtgctacaatcacgacctccaaacatagaagaaacaaatatatgcagttcttttaaacatatacttaaagttacaaaatggattttgagtgtaatttaaaggcagggtgctccctacgacttacttggttatattagtgcgaagcagggtgtggaggtaaaaagttccctttgccagaagatgtgcttattcctattaacttgtgcccatccactggccagtccccgataaggtcttctttcttaatatctaaaatgatatctacatcatcccaatatcaacttcctgagccacccactcctttgaaattcaaatgaaactggcaaagccgtacaccatatgccatggaaaagctcagtgttaatctcccatctctgtggagctcctcaagatgtccagaaagagttgtcacaatcgctggatcgtttcttactcagagtcccaatattcaggagagaccatttagtttgtggataaactcactgtctgcccattttttcactaatctccatcacttcacccagaatcctcatcctttaacccaggctacctgcgtggcagcctttaccatgaagggggtttcagcacagacgtaaacttagcagcaaagtacctcacagttttgaaattcagtcagtctctttacctgccacagaatttcccatgcactacctcacttggctctgttttcactcctcttcctcctcctacccctttgtttgctccacgcaagccataactccaaaattattatgactctctcctgaggatgtttttacaatctccttgttcactgactccttccaaactattccttgtcatctcacaactttccaagcccaactggtctgtatattaagctattgtgctacaacagtagttctcttcctcaacgaagttctgctgccagattttacatgattcatttttaccatgcttcaaccaaatgatataagtaagctcccttctacttctaaattcacctagtagatggtacctagtctctgacaagcactgatatactgggatacatagtggataaacatgaatgacaaagtccctaatttcattaagctcccaagacagaacttaagagatgcttgtttgtttggaaaaaatacagtaaaatcttttgcattaatgagtgaatgaggggcattatttccccatctgtgacctggaactcagaattgcatacataataatggttctgtctcttcttcttaggatacccacctaggccctctcattccttaaagagaggttacaagctacagaagcaatgctcctaaccaacatttactaaatctgctttatcaaaataaccaaaaccctccatttcttcaacaaaacatactaaatgctctctacagaaagctgaaagctcatggctaacaggaaactctaatttttctgctacattaaccagccaactactacttctaattatatcagataagaaggcttctactgtatttttccaaataaaaacagttccttcccaagtggaaatctaatgcaagctgttgaaaacaaagtaattctgttttcttcttatcacatgcagatgaatggatgcctcagaacgactttgccaggactacacaaaattcacttagtcctgttgcagactatgactatgatcttcttttgcagaaaggaaacgtaggtagttgtcagttgtatcagctacctattactaagaaacaaactcccctaatattcaacggtttaaaacaatacacttttattattgcttataagtctatgggtaagcagggaagttctattgatctgggcaaagtttgggtgatctcatcttatgtctacagtcagctggcaaggtcatctggtaatggctggtcaaggatagccttacatgtctcgtggttggttggctgttgcctaaagtaaagggagtcactgaaccctgtgtcatctctacattcaacaggctagctcatggcagctgggcagactccaaaagaaagtaacaggtacaacatctgctgagggggaggtttaaagctgacacactgtcacttccaacatgttctaatagcccctgtaatttataagatcttatggtttgaattttgtcccaccttagattcataagttgaagccctacacccccaatgtcactgtatgtggagataggggctttaaagaggtaattaaggttttaaaaggccataagggtggagccctaagctaatataacctctgtccttataaaaagaagaagagataccagaagtacacacacacgcacacacacacacacacacacagagagagagagagagagagagaccctgtgaggacacatggcctttgttgttttatcagtctttattgatgaaacaattgaattctttataggaaaaaaagaaaccataatactttttcccccaacaaaaattaattcaagttgaattatatacttagacataaaacccagaaccataacatttctaggaataaaagaatatttttaagaccttggatatgcaaaaaattttttgaacaggacacaaaaagagatgaggtgtcatctgtaaatcaaggagagagacctcaggagaaaccaaacctgacaacattttgatcttggacttctagcctccagaactgtgagaaaacaaatttctgttgtttaagccaccacctagtctgtggtatttttttatggcagcccaagccaactcaaacacaaggtaaacccagactcaaggagtagacagatagattccaactatttatgaaaagagctacaaagtcacattatgaaggttgtagatatagggagggatggagaatcaaagctattgttgtaatcaatctaccctactacatcagttgaggcagaattatcaacactttttgtattgtatttcaattttacctataaatttcagtatttagaagaaagtcagtgggttcccttacacagtggacatagaatgcacccaaaggatcaaaacaagtcacttaagctatagcaaagggctgagactagatatgatgaggtgtccctctaatgcatactagtcctatatagtagatatagctgcatccatagaagactcagaggcaagaagcaggactgaagtctctaggctctgaaatcagtgagcaggaatagagagcaaagagaaatcttcagaacccaacacgttggtaggttggtggtagagccaggaaagacttcctccagttctgaaagctagaaacatgttcctgaagcacagagagattggtatactctcaccagcactcagacctgggtcctgctgaaaggaagtcctgatcccacactcatttgaagccagagacaaattgaattaaacaaaagccacagcaaaacccaaactgagctcaactgcagattagattgcatcagtccctgctgcagtagcctagcataagaatagccaaggtgatcatgagtaaaaataattgagctggagaaattttcctacctgatttaaaaatatactacaaagcaatagtaatcaaaacagcatggctagtataaaaacagacacataagccaatggaacagaataaaaaacccagaaataagtccatgcatttatggtcaattgatttttgaaaaagaatccaagaatatacaatggggaaagaatagtctcttcaataaacagttcagagaaaactggatacccacacgcaaaagaatgaaattaggccttgatctcacatcagatacaaaaatcagccagaaatagattaaagacttaaacataaggcctgaaactgaaaaaccagtagaagaaaacataaggggaaaaccccattgcattgctatgggcaatgattttttttaatcggaccccaaagacataggcaacaaaagcagaaatagacaaaagggatttcatcacactgaaaagcttctgcacagcaaaggaaacaatcaacagaatgaagaggcaaccgagagaatagaacaaaatacctgccaatcatacaccttatgagggagttaatatctaaaatacacaggaaactcaattaagtagcaagaaaacatcctgactaaaatgggcaaaggatctgaacagacatatctcaaaaggcaacatacaaacaggtatataaaagatattggatttctacatctttttttaattgacaaaaattgtatatatttatggagtacaacatgatgttttgatatattcattgtttgatctagacatttgatagtcattgtggaacgactgaatcaagctactgaacatatcaattccctacatatttagcatatcttggtggtgagaacatttaaaatctactctcttagcaatttttacatatacaatattattaattatagtcaccataatgtacagtagatctcttgaacttactcctcttgtctaactgaaattttgtatcctttgaccaatatctccccagtactccaaccccccagctttattttttatatacttttcatataccaacaggtatatttttaagatgctcgacagcactagtcaccaggaaaatgcagattaaaaccacaatgcgatagcacttcacacctattacaatgacttatcaacaagatgaaagataacaagtgttgaccaggaatgtagatacaagggaaccctcagatgctgttggtgaaaatgtaacttagtacagctattatggaaaacagtatggagtttcctcaaaaaattagtaatagaacaatcatttgatccagcgatctctctactgggtatgtatctaaaggatatgaaatcagtgtgtcgaaggaatacctgaactatgttcactgcagcaacaatagctggaattaacctacatgttcatcaatggatgagtggataaagaaaatatagtatatacacacaacagagtattattcagccttaaagaagccctcttatttgtgacaacatggatgcacctggaggacattaggttaagtgaagtaagccaggcacaaaaaaaaaaacaaaatattgcatgaatgagttcatacgttaaatctaaaaaagtaatgctggagaatggggggactggggagatgttggtcaaaggatacaaaacttcagttagacaggagaagttcaagagatctattatacattatgttactgtaactaataacatatttatgtgaaaattgctaagagagcagattttaaatggtcttatcaccaaaaaatgctaagtatgtaagtaaagcatatgttaattagcctgatttagtcatttcacaatgactatcaaatgcctagatcaaacaataactatataaaaacatcatgttgtactccataaatatatacaattttgtcaattaaaaaataaaaacatgcaaaaatcccatacctttttatgactaaaaaactcagcaaactagaaatttctcaagctgataaagtgtatctatgaaaaacctacagctacaccaaatacttcatcataattaatatcaaaattataaacaatttttcccccaagatcaaaaacaaggcaatgatgtatgccctcaccacttgtattcagtattatcctggaaatcataactgtagcaatacaattttttataaaaattgttataaaattgttataaaaattgcaaaagaaataaacttctactaatttgcaaattacattgttgtgtaagcagaagtacaatgtccaaagcaatctaccaaacttctacaactagttagtaagtttttaaaagtcacaggacacaaggttgataagcaaaattaattgtataactatatataagcaacaaacaattgaaaattaaaatgtaaaacacagtaactctccccttccttttctttcctgaacaattctgtccaaaagccatcaggtggggctgaacacattaggcaaccctgcagagaagtagggtaaagttgctgtgggcctctacatggtgttgaggactgagtatgtgtagaggacgtccacaagagaagatggcctatcacagggcatcagagttgagcagactgaagggctgcctacatgagagggtgaccaggtgctaggcaccaaagcccgtgcaggttgaacagggcatctgcttgggagggaagcccagcaggaggtgtcagagcctgaatagccaccagggggcaggagtgacagccatgactagagattggtacctatgatggggttgatccaataaacacattgagggaaatgggagctaggtttctgccaataaagagatatacaaacaaggaaaggcagataattagaataaactctgtagggctggaatgaaagatattggtgtaaacccttggctttcaacaagtatagatagatattcacataaggtatatagatatgggcataaatatagaaataggaatatacacagaagttactgagcacacctaaggctcagatcttggtttctaaataccattctaaaataaaagtagacacaaaataaaataaaagggcttgttggataaatggctaattccagggctaaagaaaaaagaagtacaaaatgaatctggaacactttgtgccagaaagtaagaaagctcttttaaaaataataaaacaaataggggtataattaaaaagacatggaaatcttgaaggtgcccctatccacaaaatctgaaacaatttgagcatcaaaataaaaaataatattaatggattaaagctaagtaaaatatgaaggcatgagcctatactgatagtaattaaattcaaagtttgatgaagaacaaaacagtttcaaaatatcactacacgaaatatttattacaaggggatacatagtaaatttacagtggaaagcctaatagacatccccttcatcaattgatcaaagtgaatatcatcagtaaaggaacaaatcaaaattatatgtcacttgataggactccataagaacactatctcgctctgtgatgtttctgccaaagaggaatagcctgaatctaaccaaaaggaaagatcagagcaatccaaattctacaaaacattcttataatttgtctaggtcaccaaagtcaaagaaatactgaggaactgtttcagactagttcaactaaacataacacgattctggaccagatcaatttcttacaaagaccactctggggacaactaactacacttgaatggagtctgaagactaggtattaagaggggatacatgtctatttcctgatttttatgttcgtatggtggctatttaggggaatattcttgttcttagaaaatacacattcaagtattaggagataataaagtatcatgttggaaactttcaaatgctttgaaaaagtttctttattctgtactctaaacttattggaaattttgagactgtttcaaaataagaaacaatataactttcaataacatcaaaatatcaaatacctggaaataaatgtaatgaaacctactcaaacccagaaaacattgctgagaaaagttaaagacctgaataaatgaaatgttttacaatgttcgtacattggaaggttcagtgctattgagatattcattgtttctaaattagcacataacttcagtatgattcctatcaaaattccagcaggctacttaccagacttacataagataactctaaaaatgtttatggcaaatctacatgtctagaataatgaaaacaatcttgaaaaaggtgaacaaaactggagaactaacattatctgatctcaagccttattctaaaattacagtaatcaagacagtttaatagtggatcataggatagaacactagatcaatggagcaggagagagtgtccagaaatagacccacattcatatggtcagtggatttcacataacggtacaaagtcaattctacgtggcaaagaatgccttttaaacaaatgttgatgaaacaattgaatgctttataagacaaaaaatgaaccatgacaattttcccccacaaacacaagatgaactatgtacttagatataaaactcagaaccataacacttttaggaaaaaagaatattttcaagactttgagtgtgcaagaaatttttgaacatgaccccaaaaacatgataaaaaaaaagaaaaagatttaaaaatgttggactttatcaaagttaaaattttctgcttatcaaaagataccataaagaaaatgaatagacaagttatggtttggaaatatacttataccacctatatatgactatgggcttatatccagtgtacacaaaaactacaaatcaacaatctaattgagcaacctaatttttcaaaattaacaaaatacttgaacagatgcttcacaaaagaagatacatcaatagtcaacaagtatttgaaaaggactcaatgttgttagtcatcaaagggaatgcaaattaaaaaccataatcaaatagcacttgacacccagtagaaacactaaaatgaaaaagactgacatcaaatgtgggcaaggacaaggagcaactggaactcacatacattgctggtgtgagagtacaatgttactacactttcaggactatgtggccctttcttcaagtttgacatacatgtcaaacttatgacccgtctcttcttctcctaagtacttacccaaaagaaacgaaaacacgtttactccaaatcatgcacaagaatgttcatagtagccatgttcataactgcagaaaagtggaaaccatgtaaatgcgcataacaggagaatgccggatgcctacataggaatactacacaccaagagaaagaataaatgacaaatacacacaatacgcacatgcatgaatctcaaaaacagtataagcaacagaatcctgaaacaaaatgacatccaacacataagaatgaccctatttatgaaatctatatataaaccaaactaacctaggttgacagaaatcaggtagtgggatatagggaaggaatgaactggaaaggagtcaaagcgtttctaggatgatggagatctatgttcttttgagtggtgttacactggtatatactattaccaatattcattgaactgaacactttagatctgtgcattttattatatgttaattatggcacaaaaaaacaaaaacaaaaaagtctaaaaggtctagtatgggacttattgcagatgaatgccattttatttttttatgtaatttcaacttttatttatttatttgagacagggtcttcctctgtcacccaggctagagttcagtggtgggattatagttcactgcagcctcaagctcccaggctcaggcgttctcctgcctcagccttctgagtagctgggaccacaggcatgcaccaccacagccagattattttttattatttggagagacaaggtcaccctatgttgtccaggctggtctcaaactcctgagctcaagggatccccctgcctcagcctcccaaagtactgggattacaggcctgagccaccatgccctgacaacttttattttatttagattcaaggggtacatgttcaggtttgttacctggatatatattacatgatgctgaggtttggtggacaactggggcagctgtcacctaggtactgagcatagtacccaatagtttttttttttaatactgtctccctctcttttcctccccacctctagtagtccctagtgtctattattgccagctttatgtccatgaatacccaatatttcacccccacttacaagtaagaacatctggtatctggttttctgttcctgtgctactttgctcagggtaatggcctccagctacatccatgttgctgcaaaggacatgatttagttgtttttatggctacatagtattccatggtatatatgtgccgcattttctttatccaatccgctgttgatgggcatcgaggttgattccatatctttgctactgtgaatactgctgcgatgaacgtatgagtgcatgtgtctttttggtagcataacttattttcctttggatacatacccagtaatgggattgtcatgacaaatcatagttctaagttatttgagaaatctccaaactcttctttacagtggctggactaatttgcattcccatcaacagtgtataaccgttcccttttctccacagcctcaccagcatctgttgtctcttgactttttaataatagccagattcatgaaattttcaatgtttagatttttttcactctataagagcacagtgtttgaaaaattagaaatttaacacataatatgtaaatatggacatttgcaactcgaagcaccgaaacagttgctatgcaacaaaacggagcagcgagcgagccatcacagtatgtcatttgtcacactcaggtgatggcatattgtaacccaactgttagaaccatgctgtttataattcggtaactatacagccacaactacatcattgaagttagtagcaccagcttcaaaatcaagcaaacctggattcaaattctgcctcagaaaatttcctactacatagctcctgactcttcttccaataattctgtgaggcatgagtctggaggtgaagaggtgaaaacttcttccagttccagtctaaatggccttactcggaatctcctcattttaaatctatccctaagcaccacaaggtttagcatcagttccagtggcacaggcaacacagaaattataaataaatacattcttcaactaagcccctcacacccgcagccaccttctccagcttgttgagaaatagcaaacaagaactagatacaccacaccgagtggcgtggatattggatagtgtagccaggatctaaagtgcttttcttgaacaagactgtcaaggggcaaacaggcatttacttatttttgggttgtgcgtgattgacgatgccactctgaggcccaggattctcatttaacgcccctcaggcatccaattgtttgacaggcttaaaacacatgaattctatttccaaagacagagacagacatcagggccctcctaccagagcatgtggaagaaagagcaaacagcaaaagaaactcgctagggagggtgaggccatggacagctgccgctgcatttgttttagagtgtaagcaagaaaaatgctcctttgacatttgaaaactttctatatcctcccctgtaactgccaagctatcccagacttcctcaccacagctccaaatgcccatatttttcttcactcctggatataaatgtgactctcttctctttattataaggcaatgaaaggcctccagacatagttactggcactactgggacccccagatggtttgctgggccaggaagaatgccgtgtagcagtggggaggtaacaggttccttcacaagaagccacctgctcataattcattcacacgcttttcctctgggcaaagcaacaacaatttaaaatagtctaacgtgggccttcctggaattacaaaaataggagtgcatccagatttgaggattggttgccccctcttctctggtgccaccccagctggaagactgccaggaacaggttacggagtctctttaacagaaatggagattagcaggtgttaaagacagattagcaactaaatgagtttctccctgtcataatcagtattcaaagaggaagggtttctagttgggcagctgctaggagtcttttctgacaagaagaaatttgcctggatttgccaggctttagcaaactcaagatatcaaagtgtaaaggtaagccataaatgaagtttgtagcaggcaggcacttggctagaatgtgtaactgagataaaatggggtcacagcacgttttgttttcagggcactttctggggatgggaagggagaagttccatgtttgtgctttttttcctgtggactcagatgctgactctaattccaagactccactggttccacggtgctttctttttgcacccttagatttggccatcagtctggagggcagagggaagagcttgaacaggcttggatgaaataatactgtcttagccagtttgggctgctataataaaaataccgtagactgagtggcataaacaatatacatgtattccttgtggttctggaggctgggaagtccaagatcaagatgctggcagatctggggtctggtgagggctctcttcctagttcgcagacagctgccttctcactgtgtcctctcatagctgagaggccaacgtggtgaaatcccatccatactaaaaatacaaaaaattagctgggggtgttggcacatgcctatagttccagctacttgggagggtgacgtgagagcatcacttgaacctgggaggtggaggttgtgtgagccaggatcatgctattgcactccagcctgagtgacagagcaagaccatctcaaagaaaaaaaaaagaaaagaaagaaagataatctcttttgtgtttcttcctataagagcatgaattccattcttgagggatccactatcatatcctaattgtctcccaatggtcctaccccctaataccatcacaatgggttagattccaacatataaactctggggaaactcaaacattcagtctatagcaaacactatgacagcaaagtatgctgtaatagtcaactaggcttttagagagaaagaaagaaaacaactatttattaagcacctactatgcgccacccactttactaagctctttcattattttattttaatccaaaagacccggtccacattagaagatctggcataagtgaaactaaagacagattgagttgcttatttctttccttcccatggttttgtgtttccttcttaatgttgttttgaatttgtttgggctcaaattatattacacccttgtcatctccattagctaaaatgtatttatggctgattatgcatgcataaaataaattaaatatctgaataacattaccagtaattggtgaaattgccttatgttttcacatccttacaacaaaaaaggcatcaacaaatgaccaggaaaacaaaaggataatccattataattttccttattaacatagtgataggacagacacaattatgggcaatttcagtgtctaaaaatcaagtatgatgaaaattatattgaagttaactaagaaaaaattactttagctattgctccaaaccaactgctagtcaggatgaaagaaaatagcccctacttagaaaaatcagccactgacttagaagttgacactgaatcttttaagtttctacaaactataaaccatagctggagtgttcattttgatttgcctgggtgattctccatgatatggtttcccttcagacaccactgctttattggtgaatcatttatgctgatttagagagatattctagtgtttttctttctaaacacataagtaccaccttcagcacagcctggtatttaaaaatatatgtgtgtacccacacacaagcacacacaggatcaaaccagcataatcattttttgggctgctaatttgtgtgttttgatggtgatgtgaatttaaagtatttgataaccataaaaaccatcatggcataggtactgaccaacggagaaggataccagctgtgacattagagcaaagtactaggaccccttttgtgcaagaccaggggatcacagtaactggggtgcaccaggaagctgctatttaccaaccaaaatgaaagtcttttaatcggttaacaatggtgcaaccataccagggtgtcacaactaaatgtcagtactatacacacacacacacagagagacagagagagagagtgagagacagagagagagagagagagagagagagagagagagagagaaaaccccaaggaaggtctggcctctcccttgacctctgttatcccggtggttttagtcagcatcttgccaaatggacaccccataacagtacactcctgtagggctctggcaggtgacatggcagtccaaaccaatggtcatttctacaaggacaccccttctctttcagccctgacacctggaaaaccagtcttattcacagaacatagtagttgggacccaagcacgggtaccaccacttagattttaaaagccaaagatgtgtgaagtttgaaacagacagaaatgctccaaatccacccaagggaatctaaagaagatgatctatctatctgtctgtctgtctgtctgtctatctatctatctatctatctatcgattgatcgagagatgtggcagggcctgtatctcaagagaaagagaatcctttaccccatcaaagtgaaatttataaagaacagatccaaacatgcctttccatttctcaaaattctttgatggccagcatcactgatcttttaatatggtagaaaagggacttcataatggagcctcaccttatttcttgctgccttaaccctacattcaagcaatagtgaaccatttgtagtattggaaaacatcatgttattctatacccagacttccatttcactgggtgggcaatccattgcaacccacatcataagtcctggaattgtttgctagaaatcatcctagttgccttcatccaagtatcctgagtaacacaaggcttggcacatagtagatcccaatagtttttgttgagtagataattcagtataaccaggcagttctgaagaataaaatatggcaggcacactgtcacagatctttgcctgggagagatgaagacatgttcaatgtattctaagatcacaggatcaaaaatgaacagaggttaaaaacaaaaagactgaccacttccaggagtggtgaagacgaggagtcattagaactctcataccctgctggcaggaatgtaaagtggcacaaccacatggaaaacaatttggcagcttcttaaaaagctaaacatatacttaccataccatccagccatcctagtcctaggtattcactcaagagaagagaaagtatatgtccacagagatttggtacacaaatgttcattgaagtcttatttgcaatagctaaaatatggaaacaatttagatgtttccagtaaaacaactggtgaatggataaacaaattgtggtacatccatacagttaaacacttctcagcaataaaaagcaatgaactattgatacatgctacaaaaaggatgaatttcaaagtaatgatgctacgtgaaggtaaccagacaaagaaagagtatgaactgtacgattccatttattcataattctagaaaatgcaaactaaggataaaaagcaagctagggcttcctgagaatggaagaggaaggggtaagaaggagatattataaaaggggcatgcgaaaacttttggaaatgatgagcatattcactattttgattatgatggttttgagggtgtataggtaagtgaagatgcagctaactctatactgtatgtgctatttgttgaatttcaattataccttgataaagatatataaaagtaaataataactgagcaaggcatatgctttacgagaaaacagtcattgtggtttggggaaatcacaatgagacactaagaaggtaatgggaacactttgactttggaagtgtaagttagagattaagggtggcatttcagaaaaggaaaaatataagaaaaatgtctaacagtcaagactgtccaatgataaaataaactggccttggaggtagtgagttcctagtccctggaagtatttaatttgatgaccattaaatagcccttgaaatggattctcgccctggttggccaattattttctatgagccctaagattcttttaacctctgatacttacttgttcaccaagaagacactggcagggaatatttgctggtagcaaactccctgtcaccgatgctcatgaaaacaaccattaggaattttcctcaagaataaaagaagtgaaaataattcaaaggcttgggacttcaaagaagtcgagttgaaaggaaatcagttcttcagatataggaattactagtgagtacaaagagaagagtgagcgatggagctttggggagagggcggccgggtggctgaagtctgggtgtgagaatatcagggaggggagtaggcactggggtttagaaaacccagggggtggctataaaacacagaactggagtcgtgagcagggattgggtggctcgggtcttgggatgcttcctcacagatgctgtcggacttgctgtggaaataacttcccaaataacaaaacatatccctgtgttcaaaaacttccagtagcctcctgttgcacttagaacaccattaaaatgatttaccagggctacagagatactgctaagtgaaaagagcaagatgccaataaatgggtaacaaaaatgcaacggttttaaaaacaaagataatgaaaattcttttaccacgaatgtgtattctatctgagcattttgcacaagggtatcagtctggattattagactgaattaaaacttctcctcaagcctggcccaggtccccaacaagccccactctggcatatggcactgctctgagggggagacagggataattgctggaagcagagggtgtccgaagaggagcagttgtgacccccaccagccacctggatgaagcaattaaacaattgactgagtgaatctaacaaatgccaaagggatgaaaattgatttgggtaaaagacaaatgaggtcaatttcctcatttctgaaaaccaaggtgagagttaaggacagacccttccccagattccacatttcttccttagtccataaaggagaggatatcgctcttgtcttgtgggaagaaagctgccaactctttttacccatgagtcctccccaagaaaagaaaggatgaatgtaattgctcagagaacaacactcaccggaacatggcttactaaagggcagggatagggtattgcagggttagggcccgccacttaccactttctctttgcatacctcccagacacccccctttctccctcttcagtgccctataggcctgtgggcctcacccctcgatggctatctcaaagtcagacctgacctgtaagtcaatagtctttggcagatgtacagaactgaaattcgaatggcgaggatggcaagaaaagctggcaacttctatgtacctgcagaacccaaattggcgtttgtcttcagaatcagaggtatcaatggcgtgagcccaaaggttcgaaagatgttgcagcttctttgccttcgtcgagtcttcaatggaaccttcgtgaagctcaacaaggcttcgattaacatgctgaggattgtagagccatatactgcatgggggtgccccaatctgaagtcagtaaatgaactaatctacaagcgtggttatggcaaaatcaataagaagcaaattgctttgacagataacgctttgattgctcgatctcttggtaaatacggcatcatctgcatggaggatctgattcatgagatctatactgttggaaaacacttcaaagaggcaaataacttcctgtggcccttcaaattgtcttctccacgagttggaatgaagaaaaagaccacccatcttgtagaaggtggagatgctggcaacagggaggacaagatcaacaggcttattagaaaaatgaaccaaggtgtctaccatgattatttttctaagctggttggttaataaacagtacctgctctcaaattgaaaaaaaaaatagtctttaacttggtgaagaaggtgatatggtttggctctgtgtcctcacccaaatctcatcttgtagttcccataattcccacgtgttgtgggagggacccagtgggggatgattgaatcatgggggcaggtctttcccatgctgttctcatgataatgtgataatgagtaggtctcacgagatctgatggtttaaaaaacaggagtttctctgcacaagctctctttttgcctgctgccatccatgtaagatgtgactcactcctccttgccttccaccatgattgtgaggcctacccagccacgtggaactgtaagtccaataaacctttcttttgtaaattgcccagtctcgggtatgtctttattagcagtatgaaaatagactaatacacaaggagtaggaggctaagatctgtttctactcataacacttctgacatcaaatgtgtgggtttttttccataccaacacccaatgatccaactcttcagacaaccaactgggtgtccaaggacccagttctaacaccaactacccagaatttgcatcagaccccacaggttaagggctcagtcccacaagactgctcccatttcagatgctaattgcaagttctaggtctcctgtacttctaatagaccagctataaataaggggttcccccaccagcacccccatgttcaatggtttgctatgatggctactggaacccaggaaaaaccatttatttactattactggtttattatgaaggatacaaatgtacaccagatgaagaggcacacagggtgaggtcagaagggtcctcagcatggagacatctgtccctgtaggagttagggtgtgccaccttcctggcacatggatgtgttcaactcagcagctctctgagcccatccagtttaggggatttcatggaagttccattacataagcatgaaagattaaatcactggccatttgggatcagctcaatctccagcccctctcccctccctgaaagttccaatcctctaatcacatgattgattcctctggtgatcagcccctatcctgaagctagctaggggcccaccaagagtcacggcatttgcataaactcaggtatggttcaaagtcttattaagagtaacaaaagatgctcctctcacccctctgactcagaaaattaaaatggttttagggcctctctgttaagaactaaggaagaagatcaaatatatattttttcttctatcacaatatcacagagggtctactcagcctcaggcctagccatgttcccagtcgaggtttgaaacccttctttgcaacttgaaaccctgctttggaagtgttaggggtggggaggtgctgctttgtgtggaagctcctttgtcagaatcctggaagggaagaaaagggactggtaggatttgtccgccatgaattcttagatagtaagaaaaattaaaaggatgatacaaaggaagtagcaaattagtctatgcattaaaattggccttagacactcttctgtcttctgatagcaacagcaacaccaccacatgccaccatgaggcacatactgttatcccctttccacatatgagtaagagaaaacagagttaaaacaactaaatatcctgacttgatcattccatgactgatcattctaggcatgttacaaagtctcacatgtaccctgcaaacatgtgaaatagtatgtacccatacaagaaaaaaagttcaaacaaaaattaattaaaatttctaaataaatgtctaattaaataagtaacacagtagagaacagtgggaccaggtaagttccagagagtgtttatcgttgttgctgtttttctttgtgtttttgttgttattgttgttgttgttttttgagacggagtctcgctctgtcgcccaggctgcctctgttgcccaggttggagtgcatggcacaatctcggctcacttcaagctccacctcccaggttgacaccattctcctgcctcagcctcccaagtagctgggactacaggcgcctgccaccacgcctggctaattttttgtatttttagtagagaacgcgttagccaggatggtctcgatctcctgacctcatgatccgcctgcctcggcctcccaaagtgctggaattacaggcgtgagccaccgcacccggcctgttgctgttgttttttaagacaaggtcttgatctgtcacccaggctggagtacagtggcaccaacatggctaactgcagccttgacctcccaggctcaagcaatcctcacacctcagcctcccaagtagctgagaccacaggcacgtgccaccatgcttggctaattttttaatttggtagagtcagggtcttaccacgttgcccagcctggtctcagactcctgggctcaagtgatcctcccaccttggcttcccaaagtgctgtaattataggtgtgagccaccatgcccagccccagaaagctcttacttactgcactattccacctctttgaatgcatgaagggatgttctaattattattattattatattattattatagttttgaaagagaaagacactaaactaaggaggcccagtggcttatctaagccaaaaatagtcagggaagtgcagagaaggcagtgtggtgtagtgggtagcacttgggacttggcccctgaggatcagggttcaaatctcagttataccatgagcttcatcccttcatctgggaaactgagcatcctgacaaggttcagacaagatcatacacatacgagcacttcatgcatgcaatattatgtctggaaagcacagactttgtatgtagtggtttctgttgtcacagctgaccaaccttgagttgacccagtggttctccacccagggtggttttgtcccccaggggaccccgggcaatgtcacaattgacatccagtgagtagaggccagggatgctgccaaatatcctacaatgcacaggacagctccctgtaacaaagaatcatccagcccaaaatgtcagtcggacccaggctgagaaacactggtttggaataaatccatggcatttataacaattcgggagtagagtagatgctcaataaatatttgttgaacatatgaataaataaataatcaagttctgcaacgttgcctacaacgtggttatgtgagagcaatgttagagtaagtaaatgggtggtaaataagccagcaagactgagggataggcaacatccttgctactcaaactgtggtccagcagcttcaccatcatctgcacacctgttacaaacggagcatcccaggttccatcccagacctagtgagtcagaatctgcattttaacaatatccccagagaactcataggcacattcaggtttgaaaactaccatcctagagtctgcatttgggggcaggttatatccaatagcagccctagttccaaccgattagtgcagaaactaaggcctctttaagatcagttctgctgaatcgtccctcttggctataacccagctctatccacaggtggtatttccacctggatactctccatttggataaagaagaacatgtcccccaggcactgagcagggccttctctctctttgttcacaaagtagagcagtgagtataatgaaatatggcacatcatcaataccccctatgcagaaactgcacgggatgctacagctgaaagattccttgaagaggaaaagaaaatggtattgcaacttttatttggagcttgattacttcattgtcttttaccctccgggtgaaggggcagccaagaaaaacaaattctgcatgacgctatgagctcggatccttggttctgaatgctgctcagactttgtcctgtggcaccaggaaaggaaaagaggtgctttgcatcagccacaaagccaaacatttcccccagtcaggatgatcatattcttccttcaactactaacaggtcatcagaactcagtatttactgagcattgactaagtaccatggcactattctgagtattttacatatattaatgcatttagtacttacacaccctatgaggtagaaactaccaaattcttcattttatagataaggaagttcatgcatagagaagttaagtaactttcctgaggtgagatagctaaaaagcaagtggtgaagctaagactggaacccagaaagtctggcttcagagccagtgttcttaacccttcaaccctactgtttacattttagattttataagaataactaagatgaaatctctgctctgatggagtattcagcctggtaaagggagacagataaacagatacaacacacatatcaggcatttagagcaaagacgtactgttgtctccgtttagtaccactcgtattatatctctcatattatttgtccttatttatgtgtttgagacggagtcttgctctgtcgcccaggctagagtgcagtggtgtgatcttggctcactgcagcctctgcttcctggggttaagtgattctcctgcctcagcctcccaagtagctgggattactgtcatgcgccaccacgcctggctaatttttgtatttttagtagaggtggggcttcaccttgttggccaggctggtcttgaactcctgatctcaggttatctgcctacctcggcctcccaaagtgctaggattataggcatgagccaccctactcagcctatttgttcttactctaatttgactcaatgatttagaatcaacaagcatgttataacatgtcaggtacatactagatagtcattaaataatagttgagagaatgaataaataaaataattaatggccaggcacaatggctcatgcctatgatcccagcactttgggaggctcaggcaggaggatcacttgaccccaggagttccagaccagcctgagcaacacagcaaaaaccctgtctctacaaaaaaaaaaaaaaaaaaaaaaaaaacacagaaaaattagcccgggatggtggtgcatgcctgtaatcccagctactcaggaggctgaggtgagaagatgacctgaacccaggaagtcaaggctgtggtgatctgtgatcccatcactgcactctagcctgagctagatgagatgagagtaaaactctgtctaaaaaaatatataataataataattaacaaatgaacatggtccttcaacatgttttcaagaaagtaaggcgctatgtatggcaataggctcttaaaggaaatacctgctttttactttctatccagcactaccccccaacctccctccttaatctgtggaattgcctcttttcccagttcctcccatgttcttcccactggagctataatagctttgcattgcaacacctctggccttagctaactggccatgggtgagctcctgccaatgagttatcttctttgggaattttggaagcaggagaaagaagatcagtacaacttttccaagtagtcaaagctgtacaacgaaaaaaaaaaaaagatatctgttggtcgccacattttcttttttttttttaatttttttattatactttaagttctagggtacatgtgcacaacatgcaggtttgttacatatgtatacatgtgccatgttggtgtgctacacccattaactcgtcatttacattaggtatatctcctaatgctatccctccccgctactcccaccccacaacaggccctggtgtgtgatgttccccttcctgtgtccaagtgaccccaggaaggcagctcgtctgtatcccaagagctccataaagctttatgctaatatgcagctaagagccaaagatgagagatggagagaaattacttctgacatcgttcaagtctctgtttccagacacttaacctctgaggtttcattttctctttcataaaacggagagagtgtgggaggattacatcctgcaaggctacaatcctgctgttcaaggaagaggggctctaaccaggcaaccatgtccaagtaaggggaaagttcactcactcccctctattcaaactcagagcctctagcaccagagtaaaaccagttgaagcaaattccttttgagcttgagctccaccaaacagccctctaattctagagcacagatgatatgccctgactggtgacatgaatgggtaagtttctgtaatgggcatctcatgtttctcatgaacaaaacggcatgctaaatttacacaactggcctcctgtgtcttcggatgccatgagccctttctcaggatctgctcaccaagaggggctcagcattcaaattttgctcccatagggctgaaagagcacactcacttggcttattcataccaagcatctagcatctaggaagatggtttccagacccattacaaggctacgatgctcttcactgaagaagcacagtaccatcagtgagttccaaaagcacatcatggctcattgcaaacagcccttcagattctctagatatctgtttttcacatcttgctctgaacatcctcggaggccactgagaaaaaggaggaagtttaaatgagatggctcttctgcaggcttcaaccgcagcagctccatctgacatgctttaaatatttcagttttgcatatgtcatgtgatacattcggacattttctattttctttcttttttgagacagggtctcactctggtcacccaggctggagtgcagtggtacaatcatagctcactgcagcctcagtttcctgggacttaagtgattctcccatctcagcctcctaagtagctggcactacaggtgtgcacctgtatgttgtacaccaccatgcctggcttttatttattttttttgtgtgtgaaacggagtcttgctctgttacccaggctggagtgcagtggcacaacctcggctcactgcaacctccgcctcctgggttcaaatgattctcctgccttagcctcccaagtagctgggactatagatgcgtgccaccatgcccagctaattttttgtatttttagtagagatggggtttcaccgtgttagccaggatggtctcgatctcctggccttgtgatctgcccacctcggcctcccaaagtgctgggatttcaggcgtgagctaccacatctggccgctaatttttattattattttggtagagacagggtcttactatgttgcccaggcttgtcttgaactcctgggctcaagcaatcctcccacctcagcctcccaaagtgctggaattgcaggcgtgggtcaccatacctggccctactttatttttttttagaatagaaaaagcagctatggcccacaaaattaatatcatgatcccctaatgggccccaacctgaagtttgaaaagcattactccggcatgcccacagaacacgttccagctgggatttgcatccagtgaattcattaggtcaaaggttaccaaccagttcccacagagagcaagggtcctttgaacttaagccccacatgaccggctagcataatgttagaaacaaatcctagaaatttcatctccagaagctctaaatggagacatatacattctaagactctagccttgcttggggagaaaaaaataaatagaaggttatgtggcacagtgtctgtattcccacacaattgcaactagcaggagcggaagtagatgtctgattccctctactctctcccaaaatataagttctgaatggtaagcaatcccaagaccacgtggtctcaccccagggcctccaattccatccacctgccaagcctcctgctgaaaatcccctctcaccatggattctgcaagtctggccagctgtccttttgataaatgccctttgctaagacgcaggtcagtgtaattttccaaaaggttaggaggagtgactgctcagagagggctcgcttattatttcaaatgtcacctatcccattctctaacatttactgagttatttacaacttgattcttgctgtacctgccagtatgtctgacctgctccagtctctcctctcgtcactgtctctatagccctgaaacaggagctagagactaatggccttgcctctgaaagccagggtggtttctaacctaagatagggaaaccaccctaataggtaatttttgcaccaagtcatgccttaaacgtcgatgaaattcacctgttttgaggcatgcatggttgttgattgtttccatggggctgcagatgtttagtccattttcaatttgttcagccagattaaaaacccaatactaatgtttaaactagcaaacctcaaaaagacttcattcatttctcctctaaataatatggggcatttgtttgggtcagtaatttcagttaaagaaactttttggggacaactatttatcccatacgcctgttgaagttataataaaaacagtaacaatcatgataacataaatgtctgtcaagtattcagtgtctactatgcaccaagcatgatgcatggtattcagcctttggctatatataaatatataccgctagagagagttttatatatagttatatcagcggtccccaacctttttttggcaccatggaccagttttgtggaagatgatttttccacagactggggtcagcagacagggtgattgtgggatgattcaagcgcattacattcatcatgcactttatttctattattattacactgtaatatataatgaagtaattatgcaactcaccataatgtagaatcagtaggagccctgagcttgctttcctgcaactagacggtcccatctgcagcgagacagtgacggggcattagtttctcatctaggagctcgcaacctagatcccttgcacgtgcagttcacacagggttcctgctcctacgagaatctaatgccgccactaatccgacaggagacagggctcaggtggtgatgccagcaatgggaagcagctgtaaatacagatgaagcctcgctcgctcgccgctcaacttctgctgtgtggcctggctcctgacagggcacaaactggtaccagtctatggcctggaggttggggaccccaggtttatatggtcatacatagttaatattagttatatgtatagttttatatgtattgttatggttttatatatacatatgatcatttaactcacaacatctctgcaagttagatatcagataattatttcccctttacaaataaacgaaggctgagagcttcagtgactttcccagggccactcactcatgatcagagccaggactagatttcaggactgtccgtactttataccctacccactgcctctcaatcattataccaggaaccatcactttggagccagcatctatgcccttatacacatcaaagcactgagattactcaacaagccaactttgaaaattacctttgtcatgagctttcttttggtctagaataagaattctggaacttgagtgaatctagcctccttcttcccacaggaccaggagatcttggtctcatggcctaacgtcgttgaatagcttgacactggaattagattaaccaggatttgaatcctgctttccccatttactggttacaagatgttgggcaagtcacaaaacctctctgagctttagtttcctcatctaaaagaaaggcaaaagctaataatttctgcctcataggattatggtgtggaaaaagtgaggttctacatgtaaagctcctgtggctggagctgtgataaataaatgttagatactgtcataattaactatctgaaggctgctgcttcaggagctgttagagccatcttacatagcttcattcttacagactgaaatctgtaaaaatagatcatgatacctttacattattgggacaaagtttttacccttcatcccaccctatccaccacccacaatgccaccaccccctcctcctcctctgcggagagaagccatcctccaggctttgaaaagtggggaaatgaaaagttgcagagttgacccaggaaagccccaggttgtgtgtcccaggcttgtcctaagaggtgtcaccttcatctgctctaggaccttctgctcctcagcccacattggtaagcatttccaacccctattagacttactctggggtcttaaaaatatacatttcactgattttactgcgcatgttcttccctgcctcttcttcctcacatgccccttcctcacttttgtatctaggataattaggttatattttgacctacgagtgctcagacctagccagcactatctgctgcattatctgcatcaccatcctggttcagaaccaagtgtgggctggaaggaaggacttcaatgctcccatcccaataaatacttattttctgatcgtaacactctttgtgaaacatcagatctatactggtttcctagggctgccataacaaatgaccacaaacttggaaatttaaagcttccaagaaagaatgcttccttgcctcttccagtttctggtgggtccagggattccttgggttgtctgttttctcctctctgcgtcttttccttatctgtctcttataaagacatgtgtcattggattcaggtctttccctgacaattaggatgatctcatttcaagatcctttactttgctgaacagaggttactagagggtggaaagggtggggcggaaggtggggtataggtatattgtaaaggatataaaatctcagctcaggaggaataagttctagtgttccataacactgtaggatgactatggttaacaataatatatattttcaaatatatatccaaatagctggatgagaggatcctgaatgttctcagcataaagaatgttttagattacggatatgctaattaccgtgatctgatcactatacattgtgtatatcaaaacatcactatgtatcccacaaatatgtacaattatgtgtcaattttaaaaaatgaataacaaaaatattcttaacttgtttacatctacaaagactcctttttcaaataaattaacactcacaagttctaagtgggaatatcttttggggccaccattcatcctattccaagatcctaatgagtcccatgagacctgtggcatgcctttctttcagcatccagctcacctcactccttcaccaaaacaatgccaagaatgagagaaaagcttccattccattccacaagccagatcttcccattccattcccaaactccacattttgcagaaacccaaccctggtagagggggtttggggagtgatatggggaaatagaataaacttccaggaataaaaaggtcccctggtctcctccctaagtcatcggcttcctatggaaaaaggatcactgcatgggacacgctgcccatcccattattcactctctccagcgaggccgaggctgaggaataggcagaatttggcactttccaaaaaacatttaatatttaccttctaggaacaaaatttacattttcagataaatctaggaagtgctgagttaaataaattcaggcaggtttctctattgcaggactggagctctcaatacaatatactatgaatagaggtagaaacaatttgcattatttcctaaatttacaagatcagagaacctgtttatttgtgaggcatctgatggccttagtgttcttccaaatacacaatgggagactctggtgtagatgattctatgcaataagtagctgtcaagccatcagggacatgtaaattaaaactacaaaaatacacctctttacactcactaggatgactataaccaaaaaggcagtaacaaccacaattgtattggtgaggctgtaaagcaacatgggccctcatacttagctggtgggaatgtaaaatggccagttgctttggaaaaaacttggcagtatcttaaaaaggtcaaatttacctatgactcagcagttcccactcctaaaaatacgacatatgtgcacacataaatggttatatcagcttactcataatagccccaaactggaaaaaacccaaatgttcattcaccggtgagtggataaataaaatgtggtatatccatacaatggtattattattagctagtaagaaaaaggagtgaaatactgacacatgtgtgaacctcgaacacattatgctaagtgaaagaagccaaacacaaaagaccgaatagtatataatcccatttctataaaatgctccaaaaagactcatacagagagacgacaactaggtagtggttggcagggactgaggatggattagggattcactgtaaatgggcatgaaggattttactgaagtgatgaacgtattctaaagctgaattgtggtgatggctgcataactcagcaaattaactaaaaattaaattgcacacttaaaatgggtgaatcttgtggtaggtaaactacacctcaataaagttgtttataaaatgtgctatcacggatggatgaaataaaatcgtattaacctacaaaagatacctatcaggctattttctcagccctacgcttgtccaaatgaaggtgctgagcaatcagctttggaagtaaagtttcaagaaccaggtttgtcatcatagttgggaaagttgagcaagctgcataaagtacctaaccatgaaacacctacctgtgttttgaaggaggcattgaggtattttctattgaaggatatcccccatatggaggaatttgcaaactgaaaacacttgtgatgaatccctaatttcactctgtaccctggacaaaacaagacccagcccatagaatttatttaaatggtggaattgattagaattccaggaccaatgcgagagaagttctaagggagagagattgggctctttgatctgcctggttccactctgacttcattctaattagcaaagcttttgaggcagactgataagcattccgggcaccgcacatgtctggccactggctaattaattaatttttgactttgaacagtgacacttaatttgaaaactttctaccatccatggatgaacgtggaaaagtagggcaaaaagatgtaaaaatatgctaaaggtgccatttcaaatccagctgatttccaagagggcaaaatgggtcagtgagttaaataaagagatggactgtggggaagggacaggggagggtgtgctatgccagctctgcttctgctgtgctgtgtgtgtgggcttagccatcgatcctctctgttctctcagtgttttctcagtcattttatttgaaaattaggcgtctcctcggcaccctcatttattgagaaatgactgtgtgcattgcccatagagagaaaaggggcagaaaacaaaaaccatttacagagaggagaataggagggtggacaaagcttataactgcgcagagagtttaagtgaacactgttcagatcagaggtctgcaaaccacatcccaaaggccaaaccagcctcctacctgttttcataaatataatcttgttgaaacacagccatgcccaatttgtatatacgttgtctagggttttcatgctactatggcagagctgagttggtatgacagaaactgtacggcccacaaagcagagaatatgcactctgtggccctttgcagaaaatgtctgtcagcccctgatctagatggagtcagaattatgccttcttggtgtaagtaactaaagggacacccagaaatctttttttttttttaatcttgaaagcgcttctttttctaacaaggagggagctaacgtttttcttagcacctctgtgtggctggtgcaagggccctttctcaaagattagcctcatcccaaatctttgaagtaaagatgaacatgcttatgtcagaaaaggcaactgagaaagctaataacttacctgcaagttacagaactaatgtttaaaccagacttacttatctgcaatatgatgcctccctgctatgtcaacattaagaggaagattttggcaagagcctctgtctgacattccctttgtaagggtcaaagggctttgggaatagactttagagtaatatatttgagcatatttacgcaatcatctgtgtgcccactctatactccaagcttggagagaaacccttctattaatccccctttcaagcaggtctaagtatcccagaccataatatttaacaaacctttatcaaacagttggggacttcaaaatttttcacagagagaaactcatcgctgtcactggagttactgcctctccaatggaaactctaaaaatttaggtccttaatctccctagacccagatgtaaaaagaagttccttcctctctcagcccaaggtcttatttcccgtatcaggatggatggccataggaacagaccctttcttcagaagacacccccactccaaccacacaatggtcttcatcctccaaggtacagacaaggcattcaaaacatctacagagtacttctaaaagcatggttcattcactaccctaagggctatgccaagactagtctaactcaagttcaaagtcctttttccagcctaaaatggagacatcaggtctgattatatttccctctcagcaagactctgttcccctgatcaactataaacaaacttttggaaaaagaaacccagacttctcgcaagcaagtaagcttcaggtatcattcaaccgaaatccaatttgagagagtagcaagtttcctctaactccacaaaggcacagtcctgctaaacataatctcatttttcatcattaaatagaactctgagtatttcaggctgtagcttctgcatttaatattgacaaagattactaagagctcatatggcacccatgtgcaaattagaaaacagcacctcctctcggcaggtgcttctgttaaaattaaagtggtcccttctctgggtgaagatgccccacccacactgggatgcaaggctgggcaaagagagcaagggctgggcttcaatgtcaccattgtgcagtgagcaacctgcgcagccatccatgactgtacttggttttctcgaggaacactagtcattttctttacaactgggccttatatccaaaggcccattctgatgactttcataaacaaagttgcctgtaaaatgtaaaattgatatccacccctaaagaaaaacaaatgttgagatttttctacaaaataatttgaacaacctgagttgaattcacaagtcagccaaccgccagctgtgtgattagacaaattccctgttcatccataaaacggaggcatcaatccccgtactactgagatctcaggaatcccagcactttgggaggccgaggcaggcagatcacgaggtcaagagatcaagatcatcctggccaacatggtgaaaccccatctttactaaaaatacaaaaattagctggacgtggtggtgcgctcctgtagtcccagctactcaggaggttgaggcaggagaattgcttgaacccaggaggcggcagttgtagtcagctgagatcacgccactgcactcctgcctggtgacagagcaagactccatctcaaaaaaaaaaaaaaaaaaaaggaatacttaaaatctctaaatagacaatgcaaaatgacttggtaaacataaaacggtctgtggatattaagcagtaaccacataaaaagacagaaacagcaaatggtatcattggtgcttccatggaaagacatttctcttattcttgatgtttttggccacagtattcttccagcaaaaatctgagaagggccattacttgtccctgattttccaaaaaggtcatccaagcaataaagggtttccaatgtggaagataattagctcccagagccttcccattccacctgatcaattagactaagtactaaacactcccaagcctgaagtgcataaaattgaattgtatgtatgctttcctgttatagaatggtaatgtgctgctttcagaatctctcacacgagctgggagtaatcggaaatttttttttcaagctacctccctgcctggtgataaggcaccggctagctggatgtgtttgactaggatttttaatttcttgggggggaaaaaaaccaacaactgcaatatgggtttttgtttggctcatcagtgttgctttaaagacttctgtggaatgcccaaattgcaactgggctgtcttaacagtgccttccaccgctggaatctgcaatccagaatcagtgactgtgccggggatcagcaccaaacgcaaggccggcccatttttctttgtcaaacgctccccgtgacaggaggagatgttagacagcagtgcaggatttttcttagcaacccacccaagcatagatgtacccctctctcctaggagacaagttattaaaaagatgtatttttgaaagcaaccttctctgcatgcaacatcagtgtcaacaaataaagggggagggaaggaaaggcaaagggggagggaaggaaaggcaaagggagagctgtccagagagaggaaggaaaatgcctctgtgggcacagtttaagaaatgatcaatgcatgtgtcaaaggctgtgataagacacactgagcttatcaaaaacggaagctccaatgacagagttcacatgtgacaggaagataagagaagccgggtttttcctctccctcttttctctccccaaagaccctgttttaatttcccactctgcatgttacattttcaggcccaacagagaccacctaacctcgttcaattccttttctaatctcactgtaaatgtttccaggagactctgatttgcagacgctgacctcagtgatatttggggaaataatgtgcaagtccctgttggagatccaaaacgcagctgaaggtttcagaaaacactgaacatctcaaaaaggagtgttaagaacactgagctggaaattaaacatgcacatacatcttggctcgatcataaacacactctgtgttcttgcataagtcacatcacctaccagaaatggagtctcctcttctgtaaagcagggagagatggactgtgctgtcctatcgagaatatatatatatatattttttttttttgagatggagtctcactctgttgcccaggctggagtgcagtggcacaatctcggctcactgcaagctctgcctcccagattcacgccatcctcctgcctcagcctcccaagtagctgggactacaggcacccgccacctgtattttttgtattttttagtagagacggggtttcactcagagatgtgtgccttgcccacggacatctggccttggaacttaagttgatgtaggcctggcttcccattgctggcatttgcatctctctgcataagggccctctcagctatgggagctccctccattcacacagaaggcagaacagaagtgccagtaaattgatggtgcccagcaatcacattactgagtatatacccaaaggattataaatcattctgctacaaagacacctggacatgtatgtttattgcagcactatttataatagcaaagacttggaacaaacccaaatgaccatcaacgatagactgaacaaagaaaatgtggcacatatacactatggactattatgcagccataaaaaagaatgagttcatgtcctttacagggacatggatgaagctggaaaccatcattctcagcaaactaacgcaggaacagaaaaccaaacactgcatgttctcaatcataagttggaattgaacaatgagaatacatggacacagggaggggaacatcacataccagagcctgttgagtggtggcgggcaaggggagggagagcattaggacaaatacctaatgcatgcggggcttaaaaaacctaagatgacagattgataggtgcagcaaatcaccatggcaaattgttacataggtttgttacctatgtaacaaacctgcacagcctgcacatgtatcccagaacttcaagttaaaaaaaaaaaatgtgttgcccagaagcagcacccaaccaatgaagtcccacaaagacaaacaggatgcttccagaggtcttcagcgaggctaaactccagttgcccagagcagtacttggtgacatcctttactggctgccttcccttccctgtctcacattctaacccttctccccgcaaagtatgtcctgggattaccacccagacatactctctgtcttgtatctgtcctgagatctgctttggaggaaacccacattaaggcagtgagctaagagttaacttcaggcattaactttacgaaagagcatagctgtatcaatgttcaaagaataatggaaatgttttccttaaattccctttcctcaaaacatgcagctctaattctttttcccatccaactccacattccattcataacacgaataattctgcatatttgtggagaagttttaactattcaaagtacttacacatttaaatgtccctttgaaatttacaaaaaaaaaaaaaatctgcaaaatgggagaagcaatagcattaacctcttggtaaatgagataaaccttaaaacacaaacccagagaagtgagttaaactacacaaggtcacacaccatattgatctccgttctctttctggcctcagtggcaccactctttggggtggcatcacctgttggggatcattcagtctcaggagtagggatgggttagagtcatttacaaagcccactgcaccccaccagaatagggacctactataagaaccctttgtgaggactgtcattttctatttccactcttgcacaagtgattactctagaaggggagaaaacagctgttccgataccacccttgatgagaaagaaactgattgagctagaagtttgctgagctagagccagtcaataacgttcaattctttatctcctattcatggagtcccaacactttcaggggcaagatgcaagtgaatggagcttctttgatacagtaattcagagaataggacagtgtattcacaggtttaaatgtcaatgatgaagactaatacaactgaagaaaaatgagccttgtttaaaacaaagagagaagttctcaaactttagcataaatcagtatgttacctggagggcttgttgaaaccccgattactggcttccacttcagagattttgattccagtagatctgggtagggcgtgaaaatctgcatttttttaagtttctaggtgaggccaaagatgcagtcctggacactacactctggggcgtcactgctttaagatattactttccaaatctgatgtgcatacaaataacctggacctatagttattatgcagattctcattcaagaggtccaggctgtctttcttttttctttttttttttttttttgagatggagtctcgctctgtcacccaggctaaagtgcaggggcccgatctcggctcactgcaagctccgcctcctgggttcacgccattctcctgcctcagcctcccaagtagctgggactacaggtgcctgccaccacgcctggctaattttttgtattttttagtacagacagggtttcaccgtgttagccaggatggtctcgatctcctgacctcgtgatccacccgcctcggcctcccaaagtgctgggattacaggtgcgagccactgcgcccggcctccaggctgtctttctaacaagcctccagtgatgctgacgttgccagtctatggaccacagaaagcaatgagactccaagccaagtgtctctcaaagggatgttcaactacccaccatagagtcacagcaagcttattaaaaatgcagaccccagaaggaagactggttttagaccattcaagctattataacaacttaccatagactgggtgtctcaaacataaatgcactgttcacagttctggaggctgggaaatctaagatccaggtggtggcagattcagtgtctgtctggaagtcccctggcttacagacagctgtcttttggctatatcctcacctggtggagggagcaaggcagctctctgaggtctcttttgtaaagccactaatctcattcataaaggctctaccctcatgacctaatcacctcccaaatgcccccacctcctaataccatcacattggggattaagtttgagcatttaaattttgggaggaacataaacattcagtctacagaaagacctactgaaacgctctagtcacggacccaggaatctgcttttaacaagcatattgagtgaccctagaattttaattcatggccctatatggtattccccagccttgaataattataagaatgacctgatgcatatgttaaaatacagattcctggccaggtgtggtggctcatgcctgtaatcccaatactttgggaggccgagtggggtggatcacttgaggtcaggagctccagatcagcctggctaacatggtgaaaccctgtctctactaaaaatacaaaaattaaccagtccttgtggcacctgcctgtagtcccagctactcgggaggctgaggcactagaattgcttgaacccggtaggcagaggttgcagtgagcagagatcgcgccacttcactccagcctgggcgacagagtgggactccatctaaaaaaataaaatacagattactaaacctcaggttagacttactaagttggagtagttcaaaaacaagcctgggactctggactgtgttaatcttccagatgagaaaaactaggaaacagtctgagtgttagtactcacctgcttttcacagtctgggtaccacaatcttccctttaagctttcataggatcctcccaacttagatgtcaacatataacaacacgtaaaggagttctttaactccaaaattctgacaaaaagtttagttgagaatgacaggacccatgctataaacacacttgccatacagacttctggacgatacagtataaagactgcacagtgggttagcacatcagtgcccagttttgtctctctgcaagcagggccatctcaggggcttgccttaagccctggctctcttaagtttgcaccaaagatgggattatttgagtgccttggactcactaagttgcagaaaccctctaaaaagggagaaagagagagccagtaaccctacttagctttggggtgacacagtcttcatgctggagactagctgggatttttagctgagccagagtgagttgggtcatcatcagttggacatccctgtggacatcaagtcagtttccctaaccctgcaaatagagaaagagagtgggaggaaagaaaggaggaaggggaagggaggtgggagacagaaagaggaaattgtgccctcattacaagatgacatttggaataatgtagaaattgaaaacaaacgtcgaacaacttgcaaattgcattttcctgggacttttctcttggcatttttgtttgtttgctttaattgaaagctgtgtgtttcaatgggctcacgtggcatgccatgatcagttattccaaacgacttgggctgcatgatgctctgtttcttgtcagttgcagagcacattttctgtttcaggaactacagtacaatcactttctaactatcatatagcaccgaaatggcttcggcactcaggtgcaatggcacttcctgagtgattgggagggtcgtgcctgggtcaaagatgcagaggggccatgaaaggcagatggcttcctgggtcactacctggggaaaaaaaaagtcagaaaactgaactgaaaaaaccagcttcggggaacagaacacagtactgaggggtcctctgaccctatagtcagaaaagcaggacaaaagcctaagaatgtggctggagcattggaggaattgaggcaagaaacaggtatgaagccacttatgttatttctagacaggttccaaccaccccatcatcttttatgttcttgaaactggaagcttgtaccaatgcatcccccaaatgggaaaagttatataagattactgaacccaaatattaattatttttaccttaccacaggtaaaaacaatttaaagaacacacacacacacacacacacacaagatttacttactgtgataagagttgatacagaaattgctatatgattgacactggaccaataatctgatttactccttgcaaccaccatacaatgtaggtattatttctgttattgtttccattttacaaagccaaaaaaactgacactgaaatagtttatccaaagtaacaacagaagtcataagaggcaaagcagagaccaaaacctgggctgcatgaagccagaggtgggctttaggtatgtatgcatttatttatttatttttgatagagacttgctttgtaactcagggtggagttcagtggcacgatcatagctcactgcagcctcgaactcctaggctcaaaccatcctcctacctcagcctcccaagtagctgggaccacaggcacaagccaccatgcctggctcaatttttactttttatagagattagccccttgcattgttgcccaggctggtcttgaagtcttgatctcaagtgatcctcccacctttttttttttttttttttgagacggagtttcactcctgttgctcaggctggagtacaatggtgcaatcttggctcaccacaacctccgcctcccaggttcaagcaattctcctgcctcagcctcccgagtagttgggattacaggcatgcaccaccacgcctggctaattttgtatttttagtagagatgggttttctccatgttgaggctggtctcgaactcctgacctcaggtgatccacccgccttggcctcccaaagtgctgggattacaggcgtgagccactgcgcccggccctcccacctctcaactactgctctaaattcccttcagtaataagatgcagtcagaaatgggaaaccccatacattgctatttataaatgtaaaacggtacagccactttagaagaatagttctgcagtttcttaaaatgttaaacataaatttcccatatgtagaaagaacccagcaatatcactcctaggtacctacccaagataaatgaaataatatgcctacaaaagacttttaggcaagtgctcacagcagcattaatcacaataacccaaaactggaaacaacccagatgtccatcaactggtgagtaaattaacaaaataggttaaaaaaaatgataaacaggccgggtgcggtggctcacgcctataatcccagcattttgggaggctgaggcaggtggatcacaaggttaggagatcgacaccatcctggccaacatggtgaaaccccatctctactaaaatacaaaaaattagcctggcgtggtggcacacacctgtagtcccagctactcgggaggctgaggcaggggaatcacttgagcccaggaggcggaggttgcagtgagccgagatcgcgccactgcactccagcctgggcaacagagcgagactctgtcttaaaaaaataaataaataaataaataataagaataagaataaacatacagtggaatacaattcagcaaaatcaaggaacagaacactgaaatatgctataacacacatgagcctcgaaaacatgctaagtgaaagatgcccaatgccagagaccacatgttatgtaatttcacaatatcagaagaacaaaatctatgagacagaaaatagatgactggttttgggactggtgatgagaaatgcaagaactacgaagaagcacaagcgatcttgttagggtgataaatctgttcttaagttgggttctggtgatggttccacaattctaaatttatgaaaattcattaaattgttcattcaaaatgggtgaattttatgatacgtaaattatacctcaagggagcttttttaaaaataaaaatataaactctaaaaatttaaaaagaaaataattagaaaaaaagaaatgggctgggcatggtggctcacccctgtaatcccaacactttgagaggctgaggcaggtggatcatgaggtcaggatttcgagaccagcctggccaacatggtgaaaccccatctctactaaaaataaaaaaaattagttgggcatggtggcgggcacctgtaatcccagctacttgggagactgaggcaggagaattgcttgaacccgggaggcagaggttgcagtgagcctagatcgcaccactgcactccagcctgggcgacagagcaagactccgactccggggaaaaaaaaaaaaagaaaaagaaatgaccattgtacttgctgaacacttgatcatgatgtcatttagtctttgcaaaatggcctccgttctccctcctcaagtgctatgatgtcacctcaggcacaggaattttcattcttttaaaacagggtctgacatgcaggagccactcagtaaatactcgctgcatagagcaagatgggcgacaggcagacacggattcatatcttgactcagttattgcagaatcatcagtttacttatatgacttaaatatattacaatgagtaataatacctatggcagacgttgctatttggctccccaatatctgtttcaattcccctctcttgccaccttccactatagcagctgggaaaagttactttctcagaggccccttgcagccaggtgtggctcattagactttaaatgactgtgtgtgtcattgtcgttggggatggagcgttaggagagtgattctggaaaacatttttactctactgataaaacgaacagtgcagctgatgccatttctgcttccttcttcctgacttgaatgtagatgtgatttaaggaatgcagcagccattttgtggccatgtggaaaatatcacaaaacaagaagttctggcctgtcattgctttggtttataactctttccttttgggtctcccaaaccatatctaagttctattattacatgactggaagagtgaggggcacctctggacagcccctgctttagcctcagttctaaatatccacttagtccctcttttcatggattcattggaaaatccgaaagcagcagtcccaatgggaaataaatgggtctaatttcagaaaagacaagcccatttctcttctccccagcaatctcataatactatggtaataaccaataatgatagcaggtaattaatacatattcaccacgatcaatgtctctcaccataatcccattcgtctatccatgatctttgtggaagaggaaaatttcactgtgagatattccagaaacaagcaaatggtccttccactggctgcctcaatgtcaattctctctgttctttcagaacaggaagtcagaacaccaagcaatcacaacagcatgaaggtctcctgccttgctctacagagggacatctattgttctgacctccagcaggtttgatttaaactgacagagacaggttccctttaggcacctgggagaatcatgatgcagaaggtcctggaatctgatggtaatttccagttagtgatcaggcagaatgaaatccatggtgcagtaggatgcactcctagaagacagctgagattaaagaatgggacatggagctgggcacggtggctcacgcctgtaatcccagcactttgggaggccaaggcgagcacatcacctgaggtcaggagttcgagaccagcctggccaacatggtgaaactccgtctctactaaaaatacaaaaattagccaggtgtggtgatgtgcacctataatcccagctacttgggaggctgaggcaggagaattgcttgaaccccggaggtggatgttggatgttgcagtgagccaagattgtgccactgcactccagcctaggtgacagtgagacttggtctcaaaaaaaaaaaaaaaaaaaaaaaggacatgggaagaagaattgggagagagtagcgagcagcttctgacatggcctccaaggacccccaccccctggtagtcttgcccttgtgaaatcccctccccttgcatgtgggccagaccaagtgactcacttctaacaaacagaatatggctaaagggatgtcatttctggtattcggtgtcttagtccatgtagactgctataacagaataccagagactgggtggcttataaacaacagaaatagttctttctcagctcacagtaagtctacaatcaagatgatactggcagattcagcgtctgatgagaactcacttcctagttcaccaatgggcgtcttttcactgcatcctcaggagacagaagaggctaggaacttccctggggtcccttttaaaagggcactaatcccattcatgagggccctgtcctcattaactaatcacctctcaaaggccctacctcctagtaccatcgtcttgggcattgatttgaacataggaattttgaggggccataaactttaatccaaggcattggattacaaaagactgatttccatcctattattctgtctctagctctactcgtgcttgctgtctcatggtgagaaccacattgcaaggagttgagagcagcctcgggctaacagccaccaagaaactgaggccctcatgctgacatctcatgaactaaatcctaccaaaaagcagagtgggcttgggaacagatactgtcctagttgaacctgaagacgattaaggccccaggtgacaccttgatgaagccagtgagaggccctcaagcacaggacccagccaagctattcccagatcctccacccacagacactgtgtctttaaaaactgctaagtaggccgggcgtggtggctcacgcctgtaatcccagcactttgggaggccgagacgggcggatcacgaggtcaggagatggagaccatcctggctaacacggtgaaaccccgtctctactaaaaatacaaaaaattagccaggcatggtggtgggcacctgtagtcccagctactcgggaggctgaggcaggagaatggcatgaacccgggaggcagagctcgcagtgagccgagatcgcgccactgcactccagcctgggcgacagagcgagactctgtctcaaaaaaaaaaaaaaactgctaagtgttgaggtcctttgttaccacagcaattgacgcctaatacagggaatgagtcatggggatattttttaaatgaaaaaaactccacatacacatgaatgaatgagtactcacaacctttcccttttccacactctaaaagggtttttggttcattctgtttgggggttgtttttgtttgattccgctttgggggttttgccttttgtttctttgtgctcaagcagctgctgatcaaatctgagcatttcctgtgttaatgagaacagtattggtaattattattatgctaatatttcatcagcgcttatagcaagccctgtgctgagctttgtaagcctcacaacaacccagtgaaaaaaggtaccagcattattcttcttttgacatttgaaccagagcaactccatcttgaataggagctggctaaaatgaggctgaggtccaccgggctgcattcccagacagttaaggcattctaagtcacgggatgagataggaggttggcacaagatacaggtcataaagaccttgctgaaaaaacaggttgcagtaaagaagccggccaaagcccaccaaaccaagatggcaagggagtgacatctggttgtcctcactgctacgctcccagcagcccgtgacagtttacaaatatcatggtaacgtcaggaagttaccctatatggtgtaaaaaggggtggcatgaaaaattcaccccttgtttagcacataatcaagaaataaccataaaaataggcaaccagcagcccttggggctgctctatggagtagccattcttttattcctgtactttctcgataaacttgctttccccttactctagggacttgccctgaattctgtcttgcacgagatccaagaaccctctcttggggtttggatcaggacctctttccggtaacactttcacacgtgaggacatggaggtttagagtgactattcttgcctgtgtcacttaactggttagttgtggagccaaggtacaaacccagggaacaagactctacctcttcaccatatcactgagctggacagagctgaagcagggaaaagtgacagaaaggctagaatgacttaccctggaaaggtcagggagcttctctgacagattaaagaaatatttaaaaggatacagtaaggggacatggaacacaagagctgcccacagctaagtttatgagaaaagtcagaaggagggagatttggaagaaactaataaggaattggactcactgcccagcaggctaaaggagctggaaaagggagagagggaagatagatgatagcaaagaaagaagggagagggaggcaaagaaagtgagggaggggagagattgattaatttagttatacataatcctgtgcatgagccctttcagcagttttaagagatgcagtcaacactgaagctgagaggtgaagccagctgggcttgtgggttaggtggggacttggagaacttttatgtctggctaaaggattgtaaatgcaccaatcagcactctgtcaaaacggaccaatcagcactctgtcaaaacggaccaatcagcactctgtaaaacagaccaatcagcactctgtaaaatggaccaatcagcaagatatgggtggggccaaataagggaataaaagcaggccacacgagccatccgcggcagtaggctgtggaaggtagttcttttctgttttgcgataaatattgttgctgctcactagttgggtctgcactacgtttatgagctgtaacactcgctgagaagttctgcagctttcctcttgaagtcagtgagaccacgaactcaccagaaggaagaaactctggatacatctgaacatctgaaggaacaaaccccggacccaccatctttaagaactgtaacactcactgtgagggtcagcggcttcatcctttaagtgagcgagaccaagaacccaccagaaggaaccaattccggacacaaaactattttcactgtacgagatgggcactgcaccaggatcacttttgctcccttcattctaggagtttctctgtgtatcgtttctaagatgccctctatttctttgactgttctttgtcttctgtgtggatctgagcttattcttaattatctcccattgatgccactgtcaccaacccagtcccaaccctcaccttgtctctcctgcattatttcaacagtctccaagaaagccttcctgcctccagtcctatccatggccttccttttttgtagactagtgccaagcaatgtaactgaagagacaaatctaaccaggatgttgctctgcttatttaaaccatcactgattccctgtttcacacagaatcaattccaagcttcaaatcattatggaaaagatcaccacctcttgtttgggctacagcaatcgtctctaagtggaacaccaagcagtaaacagtaaatcccttcctcacctcctgaccaccacccccccctgccccgggggcaggatacctctgcagaatggaaaagcaatcatgtcccttccttaaacttccagaggtgtggtatgcatgtgtaagcattacacattgcaggctcaagcttcatcctgtacaatttgcaagtaaaaaaaaaaaaaggcagcaaactttattttccccgatttcatcttgctgcaagcaccattctgctaggtagtatgaaaaacactaaacatgccagttttgatatcgtcatctcaggaagtttaaaacggccttcagttagtacagactctttaagataaatattcaatcatcccaaagatttaaactccgtaccagggctgtttcttccacacaatgtcacacgggtataagaaaatgtgtgtgtgtctttggattagaaggaggcctcaagtctaccagacacatcttgggacttctctggttttttcaacagtacaggcagactggcccatcgctgctgtctctcaatgtttggggtatcacaggaggaggacttgttgaattctgtgattctggccactctcctcgtgttacaaagtccctatctacagagtccttgctctgaccccagtggcagtccatgggttctctcagaatctccacatcactctgcagggatccaggctgcagggaacccgtccacccgcattccttcgcaaaactgaagggggtttcctaaaggatggggaagtgaaaatattcactttgtaccacagaaaatgaagaaagtgcccaaccgtgctctgaaaggcctcaagacttagcttccagttttgtacatcacttctagcgtatcgtcttagagagggcagtcaagacacgtatatttcagcatttttcttttttcaagacagagtctcactctgtcacccagactggagtgcagtggtgtgattttggctcactgcaacctttgcctcccaggttcaagtgattctcctgtctcagcctcctgagtagctgagactacaggcatgcacaaccatgcccggctaatttttgtatatttagtagatatggggtctcactgtgttggctagactggtctcaaactcttgacctcaggagatccacccgcctcagcctcccaaagtgctgggattacaggcgtgagccacctcacctggccagcatttgtttcttttgacttcaggtcctctctgaggaccaaagagccttcctcttgccactcagcacttcctctagcgcctccaggagctggggcatgaggaggatctgtcatgaaactctatggtctaagttggccaggcttgcacattggtatgcgaaaaggccttttggaatttagaaagggcaaacaaatgcagaagcatttatcttgtaataaagtttggctttaaagataattgtcttgccatttcctggagaaaaaaaaataagtcatctttgaaactcaacattgaatgatgagctttgttccattccatagcgtcctctccttccctagggcaatgtctcatggcttagcttttgtaacacaaggagtgccgagaagaaagaaactggctgttaagggagtaattaatcaccaagaggtatttcaaaaacattaaacctatcatatttgttgtgtgtacagtttgtacatatgtgtgtgtttgtgtgtatttgtacacaaatggtccatgttctacaccatgggtttccaaactatgccccacagtccaagtccagcctgcctcctattttttgttgttgttattttagtgtgttttacaatttttttaaattgtgttgaaatacacataacaggctgggcatggtggctcaggctgtaaacccagcactttgggaggccgaggcaggtggatcacgaggtcaacagttggagaccagcctggccaacatggtgaaaccccatctctactaaaaatacaaaaattagccaggcatagtgctgtgcaccctgtaatcccaggtacttgggaggctgaggcaggagaattgcttgaacccgggaagcagaggttgcagtgacgtgagatcatgccactgtactccagcccgggtgacagagcaggactccatcttgggaaaaaaaaacacacacacacacacaacataaaatttaccatctaagtcattttaagtgtacagttcagtgtctttaaacacactcataatgttgtacaaccatcaccaccatccaactctgcaattcttttcctcttgtaaaactgaaactccatacccattaaacaactccccattttccccttccctcaagcccaacaaccaccattctattgtctctatgaatttgaatataagtacctcatacaaatagaatcgtacagtgtttgtcttttgtgactcgcttgtttcacatggcataatatcctcaaaattcatccatgttgtaatgtatgtcaggatttcctaaggctgaacaatagcctattatacatacgtacgtagcacatcttgcttattcatccatcagtggatgctctcacattttagctattgtgaataaggttgccacggaagtcgatgtaaaaataatccctttgagaccctgctttcatttaattattttttggtatggctagcaagccgagaatgatttttacattttcagatgattgaggggagggggaacaaaagaagaagagtatttggtgacatatgaacaacttttgaaattccaagttcaatatgtatgaagttttattggaacacagccatatgaattcctttgtgtgtcgtccatcgttgctttcacacacgagaaaagaaaccatacagaccacaaagcctcttactatctggtcttttaagaaaaagtttgccaaccccttttgtatactggttggcactttgtttttttatcttaaacatatgttggagatcatttcatatcatactcctcctacttgagtctacttctttcaaaaaggttgtttcagaaatttgctgttacaaacaacaccataatgaatattctaagacatctagccttctatatataacatgtctctctctgaacctcccatcccctacatacacacagacacagacacacagacacacacagagacaaccatgagccccttgaaaacagtgacctcatctatttatctttatggttccagagcagaactaaagaaaaacatcaattgctttctttcaatacatttgtttttttataaacataaaattaaagactacttagaatcctctcaaagttgaacatggttcaaacaaaagaatttgaacttgagaaaatcctgcatttttttagtatggaaatctatcttctccaccattctttgtattcctatttgtctcctctgccttcttttttttttttttttttttagcaatttgacttatgtttagcagccattccccaagatagcatattcctctgtgacaagatttaattaaacttccagcaaaataattagcaaggctatcttaaaagaccattttaaaataccagagtgataccaaggagtgaatagagttaacactgtcatcagagatcaaagccatcagaagacgtgactgaaaatttaacctccagcagccgcctgatgaagaggtacacattggaacagttgtgatagcctctctctcgggtcccatcgacaaattcatttgacatggaaaatttcccaaaggaagcttaaaaatggtaaatttccattaattacatagcaaagaatgtactcttcatattttattatccattaggaaactttggaggaaggtgtaactgcctcttataatgtagactatccttctttacttggggatactgatgagattagcaaacagcttctcaactaatgtgaagacttatttggagaaagacactttgtaaaaactaccttgactgtgatggtggtgaccctgggaatggttgtggtggctatcttggcgaagagccccatggcgatggtgacaattccaaggctattagcttggtgcaaaattgcagttgtcattaaagtaataccaattcaggacctactaccctccacctggaatctcggagagaatgaaaaaagctgaagggatccaaagctagaagacttatgttcgagcctctgctccaccagtcagtcactctgtggtcacgaggaagtcccttttcctctttaaacctcattattcacctgtacactggctatctggtatggtttggacctgttcccctgcaaatctcttatcaaattataattcccaatattggaggtagggactggtgggaggtgactggatcatgggggcagtttctcatggtttaacaccttcccctttggtgctgtcattgagatagcgagttctcatgagatctagttgtttgaaaagtgtgcaaaacctccccactctctctcttcctcttgctctggccatgtgaggtgcttactccccctttgtcttccaccatgactgtaagtttcctgaggacttcccagaagctaagcagatgccagcatcatgcttcctgtacagcctgtggaactgtgagccaattaaacctcttttctttataaattacctagtctcaggtattttttatagctgtgtgagaatggactaatacggtgtcatactctcctccttacctgttttgcacagttgtgaggataacaagagatgttgttgatactcagtgtgatggtgactatagtgattctatacagcaaatcctattcttgtctttttcaccgtcttccatgaacatatccacctacaggcagccccaagagatctagaagtggaagaacaaaggccagattctggttactttgcaattaacacagagatatgggggctctcatttcttccttacaggtcaatagctcaatatggtaccttaattcttttcctgtgttaggaatatattcataaagccttatttactctttggagatgtagtatgaagtacttccaaacagtactacttccaataattggtggtgaccaattattgctctttttatctctaaaaaactaagaaaatcctagttatcatttcataaagagatattaagactggatatttaagcatttattgtgtatcggccatggcactgagtacctttgaagccagtatcattattattctccattttatgaataaggaagttaaggatggtgcatatttttctgcacctgcaatcttttaaaaaaaaaaaatccctgcctcacacccactatgcccttcccctctacctcagtcactgttgttcctcttaccaacatcaactgccccatgaatcagagatctacagaccctgttcctagtaacacaccttaataagcacttaaacagtccaatggactagcgcatgtaatggacctagcttgttacaaaaaccacaatgaccgtttagtacatggtagctgcaatctagccctgtggtccaattcaggagcttggaattctgcattcttggttcaaaccacttataagaagaaagaccttagccaaccaacgttgtcatttcttcaagactcgagttcttcatggagataacaatatatccactcactgggttgttgggaggattaaatgggttagatacatgtaatgtgcttcggaccctatctggtactgtaagcagcccatacatgcaacttccactactattatttcctgacaatgcaaagcttctattaagtgagtttttttctcctgatgtgctgtgttcattccagataaaccaaattaaccttaggaagcttattacctttaaatcttgattgcaaacatgctccctcccctctggcaagactctctcatcctctcaaatcctctgttaatatttctgattatttttttcttaaatagggttagattgttttcctcccaacaagctcagtagaaaaatagacatgagggaaaatctgttttagccattagctgtgtctctaatgctgccagcgacctcggtggggcccttgctgaccctccttacctcccatctgcatgcagatttcctttaattttaataaaaacagtaggaggtcaatcgaccacagcctgtgacctcgccaacaaaacaagcccccaacatgggactcaaagttcagggagcttccaagtgcaatttaaaataaatgctcacatagagctatggtcagcactcggaatttgtctcaaagtgatttgcatatttagaacaatattctccaatgctttggcccattggggagtgatttgcattcagggaggaaaggctaatattctagtcttagcaattattgaaacacatccagtcggtactctaataaattatcttaacccaattactaaaaacattgcaaaacattactgtgcatggaagaccgttctgcccaggaatctttattggcagggtaattaaaagcgtactagctatggcttctgctcaaatatttggggatgttttgtgccatttgaattagctctcttggactgagaaaagagatatctgacaactacttgctttatttatctctgccttccccacctccttgctttggggaccactcataattaaggtccccttcccacatcaatgccacctacaacttccttcctaccctaatcctccttgcagaaaaaagtacttacataggcccagtccctccccttcatgcctgctatcttttatcaaagcaaaagattttgttagccattatgtagtgggtgcctgctatacatcagaagcttctgcattatgagaataaatcctacagtaacatttcggggaatggtattcctattccatgcatgagaaaagtgaggattaaaaggttaagtgaatttccaaagttcgcacagctgatgagttgcaagatcaggatcaaactaagggctggtggttccaaggtcctcctttccttccccaacaaggatttatccactgcttatatgtgccaggtaccatgctaggccctgggaataaggtaggaacgacatcaggcagactccctgcccttgcagatttttgtatccattcatccatcctgtgtatcagtcagggtacctcagttatgctgatgtaacaagcccaaaatctcaatgggaagtaacaaacatggctttctcattcatgcttcatgtccatgagggttgacttagcaattcacatgtccacatctacctttaaagtaggtgggaaaatataatcctaccagaggactggaagtcagaaagttggaaatatttgataaaaagcattaatgacaacctcagctcctgtgacaaaggggaaggagtcctttttcagaacaggagctaggagctctccagtgaatttacaatcaagctgcaaagctggccgagttccccagcactctacatacaaatccgacattcatctccaaacaccatctttgtcagaccacagagacccctggcatcaaaccctgccatgatcacagggacatgcaacacacactccctcataattaggctcatcttcacaccccccagcatgcgccaggcagctggaccctgagccaagatatgagggtgcaaatgaatccagcctggagcatagaacagaggtggccagggccgctctgcctgttgaattaactctttagaatcacttttttttttctagatctgggcgtctttggcagacagccacacagatatggttctccctccatctcattaatgacatggtttgctgtaagttctcctttcaccacagcctagacactgggctcaaatacatcatctaatttaatctgcacaatgatgcagacaggaatatactaatgacttcattttacagataaagacacaggatctgaaagatgaaagaaacagctcaaaaagtggcagagcaagcctttgaacccaagtctttgtgattcctgaatacacagcagcctggagctgccagattcttggtcaggagcatcataataaagactctgactccatgaccctttgtgtcatgggctaaccaggacaagagacaaacaaaatgttccaggatccaaaccagaagtgactgatcccaattctagtccaaatcccccggcatgcaacgtgaaaaaaagaaactaattttcaagcacctactttgggccaggacaccagacaagtccagactgtgaatccccgtagtgcacatgggctaggcccacagtatcaccacatttaatctttccaacatcattgcaacttgaatattttaaggataagaaatctaagtctcagaggggatgagcagcttgcacaaggccatacagcctgtaggaggcagagctcatacatgaattctgtgctgcccaacttcatgttttctactccactatgatgcttgtttttaaatcccaggagaaagccaggaatgcctgttgggaagattcccacacacacgactcacacaaacatgggcttttctatgattgtctcagaaatagcacagcatcaacccggaaatagatttgaggtcttcccccaagttgaagtatgcctcactccaaaccaagtccattagtttgctaggggatcgcaataacattaccaacaacagaaataggaagaagaggaggacagacaaaaagaaggatgaaagaaaaaggggaagaggaaagaagatggaagaagagacaggagaaagatggagaaggaaggatgaagaggagaaggaggaagaagaggaagaaagaggcaggaagaaagaccattatcaccctccccccgcccaccaccaccgtaattaaacattaagtactaggctctgttcagagactttatgtgcaccagctcataaatctttcccagaaagctccaaaaggtagggagtactattattcccattttacagacaagcagaatgaggctcagaaaggtcaggaattcttcccaagatcagccagctactaggtggaagagccaagcttcaaacctacgtctgaatgcaaaatccattccattaaccagctcctgcatcttcctctgaagaaaagcaggaagagcttcatgtggaccagggcttcaggggacataaccatgcttcctgccaggaaaaaaagaaaaaaaaaaaaaagtaggaacagggttggttagtttccaaagaggattcctgttcaacattctgcttgctgcctccccaccctcctcttggtgccccactgaaatttcttttctggtggccacgtccctccccagctgctccccgtgacggccaagagcaactggcatctgattatggcccccctctagagaactgcttcattcctcacatcaaggtggggctatctctgtgctacatttgagcccagaactccccaagggaccagtgtgaagcttctccccatccttgctcagctcctccttcccctttctcctgaaaacactccccggataaactgcttgcccccgaatccctgtcttgggctctgtgtctggagaattggaccttaaccccacgtctcctgctcccatctctgcctctgctcacttggggctcttggacaccagcttctgacttctgctactcggcctcagaggtgggagaaacaggggagaaggcaaagtgaggcactcagggagccaaggaggctggaggcacaaaggcaggcggctgagggggcagccagctcgaccacgcaggcagtgcccggccgcccccacgtcagcctgcccttggcctcgtgcactttggataattaagaacagatggcccatcgccttggccaagcctcattaactccttaatgccgttcttctggaggccggatggtcagccggaaaagctcgctttggaggtcatctgattaaatgatgcccggccagagggctgcccagtccctcttctcaggctggcagctgccccggttgcttcattagagctgccattgtgaccagatgggccaggaaaggggctggggtgtgcttaagtgaggggaatgcgctgagtgaaaaggcttaggagtcagggaacattgccctgaggcattgggcaagtcacttaatctaagtctcagtttcatcacctcccaaatggctacagtcatagcaataacagggccaggcacagtggctcgtgcctgtaatctcagtactttgggatgccaaggtggaaggagcacttaagccaggcattcaagaccatcctgggcaacgtagcagtaccctgtctctatgaaaaacaaacaaacaaaaaaaatagctgggcatggaggttcacacttgtagtcccagctactcaggaggctgaggtgggaggattacttgagcccaggagtccaaggctgcagtgagctatgatcacaccactgcactacagctgtataatcaccactgtagcctgggcaacagagtaagaccctgcatgtaaaaaaactattttaaacaataatagttgtaatatttttctaatggcgattattttttcaataataattattctagtaataaaaataatgtgccaaacactttacatgtcatctcagttactcttcacaactgccctttgagatggtacctcttatgatctgtactttatgcatgagaaaagctgaggctcagagaagctaagtaacttgccaagtttacatacctggcaagagtcaggcagaatttgaacccagttctggacgattccagggtgcctgatcttcaccactgttttggcctgctataacaaaatatcataaactgggtggcttgtaaatagtagagatttatttcccacagttctggaggctgtagagtccaaggtcatggtgctacaggatagagggtcctaaacatggtagaagggcaaataagctcccttgggcctcttttttgaaagggcattaattccattcatgtgggccccatcctcatgatgtaattatttcctaaaggcaccaactcttaatactattgcattgggaatcaggcttcagcatctgtattttagggagacaaaaacactcagaccacagcaaccagcctgcctgtcttacagggagatacccgtctcaaaggaaaacaagaagctacaaaagcattccctagtccttggcacaggaaaaaatctttgactccctccaaagaaaactttaaaacccatattctttattttgtctatttttcacccagactatcttctcaaacctaaaaatcctaggcttatattgaaaacttcaggtccccattgtggaaaagagtgtggcaattcctcaaagatctagaaccagaattaccatttgacccagcaatccccttgctggatatatacacaaaggaatataaatcattctgttacaaagatacatgtacatgtatgttcgtggcagcagtattcacaatagcgaagacatggaatccacccaaatgcccatcaatgatagactggataaagaaagcatggtacatatacaccatggaatactaggcagccataaaaaggaatgagatgatgtcctttgcagggacatagatggagctggaagccattatcctcagcaaactaacacagaaacagaaaaccaagcgccccatgttctcacttataagtgggaactgaacaataagaacacttggacacagggaggggaaaaacacactggggcctgtcggggatggggtcgggttagggagagcattaggaaaaatagctagtgcatgctgggctgaataccaggtgatgggttaataggtgcagcaaaccaccatggcatgcgtttacctatgtaacaaacctgcacatcctgcacatgtaccccagaacttaaaaataacttttttttgtaaagaaaactccaggttccttgcaatgcttctagctacctggaacaagggaaagaggacacatgcacatctacacattttggataaagttgactaaggagaagactgagaactgaccacgtctttggtcaatgaaagaacccaagaagcttacacacttgtgcctcatttgagaatcctgggcacgttaggagagcggcaggtgggcagaacatgggcaacagatgtgggactcggggaaaagcatacggctgaacttgagggagcaggaacccactttctacacacaaccttgggattggctgactccagcaggatctggtgcctgcgtctgggcacaagcaccagagacccacaaaggaatggttaattctagtctctgcttttgaaattctaaagtgctgtgccagaaaatgttttatttcttgagctagataattgttccatgggtgtgttctgtttgtgaaaattcattgagctgcttacttatgtgaatgtacttttctgtttgtacagtatacttcagaaaagagtttttaaatgaaagaaaaatgcctctgatgaaaaacagaaagtgcttgggaaagcccaaactgctactcaggttaactgttttgatgttgttagcatgttttaagcccctcctcacccttatccagcaagtctgttcctcatcttaaaacaaatgggcactcagcttgctgaatattggcttgcttttgtctccacatctgtgcaggagagttcccccaaaaccacctctggaagagttcatgagcatcttacaggcaagactttattactctgtattctccaaaggcctttacatgacaaagatgttctcttccctcatcactttcgctccttgaagatggagacgatgacatggtttaagcaactggatggagttcctcattctggcaatcacaagattcgttgccaaaaatgctgaatgctcagagcattgagcttcctccaacccactcctcatcccaagcatcttctccatattctctgcttttgacttgacttctaagtccagtttgctaattccatttggatctgctaattcttctttccattgttccccacctcctccaacttcaaatcactctctcctccagtggttcccatcacaattagccttcaaccagttgtccaaggcaaaacctcagaatctccctagattctgccctctcccttacatgtaatatttaggtcctgaacccatctgcttctccttacctccacaggcatcactgcgatccaggccacctctatgattaccatagctcccaacttaccctcctttcaaactaccctacatccaacagctaggataagctttattattattattattattattattattattattattattatactttaagttctgggatacaagtgcagaacgtgcaggtctgttacgtaggtatacatgtgccatggtggtttgctgcacctatcaacccatcatctaggtcttaagccccgcatgcattaggtaatcgtcctaatgctctccctccccttcccccacaaacccccgacaagccccggtgtgtgatgttccccttcctgtgtccatgtgttctcattgttcaactcccacttatgagtgagaacatgtggtgtttggttttctgttcctgggttagtttgctgagaatgatggtttccagcttcatccatgtccctgcaaaggacatgaaccagaatgagccttttaaaatgtaaatctgatgaaagaagttccctgctctgatcctacaatggccttcccatctcacttacgtgtgatcacccttgcaagacctagacaggttgatatctgcttaaccacctccagaccagcctctcactcagccccaatagcagaggcgaatttccatttcttgatcacactcaactcatgactcacgtccaatatacatataccttttgcagatgctgttcccttgcctgcaacactttacccttggcttttccatagctggtgacttttcatgtttcaggtctcaaagaaaggtgacctcctcagagaagccttccttgaccacccatctaaattgctgtccaattattcttcattgcatcttctcgtcttatctccctcatagcacttaatcagaagctggtattttttatttgcttactgtactatctgtcttttgcccaaatagtaaggaccatgacaccagaggccctatcttattcaatgctgagcccctggtgtgtggcatgcagtcagggcttttttttttttttttttgagacagagtcttgctctgtctcccaggctggtgtaatctcggctcactgcaacctccgcctcctgggttcaagcagttttcctgcctcagccgagtagctgggactacaggcgcacgccgccatgactggctaaatttttttgtactttagtcgagatggggtttcaccatgttgcccaggctggtctccaactcctcagctcaggcaatctgcctgcctcagcctctcaaagtgctaggattacaggcgtgagccaccgcgcccagcaggacttgttgaatgaatacacctggcattctccccagcgtcactcacccagactgcctgcaagagacatacctggccctgacccacccccttcctgccatcccaattaaagaagggaaattggacatgaaataatgactcctgattcttcccgggctgctttggcttccttaacctcactcctcgcactcaaatttccaaaaccaacagaaagagcaaggtccttctggactcaggcctgcgttactcttttccaagtatttgtggtcatctaggctcatcccacatttcctattacactggaaaccaagaggtagccaaataatatggtaaatcaaagagtctgggctcgggagttaaaagcacctaaggtcgaattctggccgcatcctatttattagttatttgttctttttttttttttttttttttttttagacggagtctcgctctgtcacccaggctggagtgcagtggcgcgatctctgctcattacaagttccgcctcccgggttcacgccatcctcctgcctcagcctcccgagtagctgggactacaggcgcccgccaccacgcctggctaattttttgtatttttagtagagacggggtttcaccacgttagccaggatggtctccatctcctgacctcgggatccgcccgcctcggcctcccaaagtgctgggattacaggcgtgagcgaccgcgcccggctagttatttgttcttatactaatccttatcagcctccatttctccttctggaaaataacaagaattctgtctccctcaagacagagtctgtggcattgtggaattatttaggggtcaaccatttcaacgaatgctacatgaaatctatctagagagtggcacaaagaactcaataaatgcttttgtaattaattctaatttctcccagaagctggcatgtctcagcttacattttccttcctctgagaagattcgtttaactccaccaccctctaagtctgggttagatgcttctcctaagtatagatctggaaccctgtactcagtgggttctgtggatccccactgcattacaagtaaagctaagtccctacaccagcctatgagatgccacgtaacagagtccccatcctgcctctggccctgccctcgccactctccccatcattccctctgctgcagccacattggcctcatgcggttcctcaaacttcccagactctcacccactattccctcttcttagagcatgctcccccggctatttacccagttccctccctcatcccctcaggaccctcatcaaatagctcctcagtgaggctttccttggccagtggaaggctgaataatggctccccaaagacgtccacatcctaatccccagaatctgtgaccatgttacctttacatggcaaaaggaactttgcagctgtgattaacaaggatctttaaatgaggagtttgttctagattatccaggtggtttcaatggaatcacaagagtccttttacgagggaagcaggaaggacagagtcagagagagagcgagtgattggaagatgctaagatgctggctttgaagtggaggatgaggctatgagccaaggaatgtggatggccttcagaagctagaaaagccaagaaaacagattctcccctacagcctccagaaggaacgcaggcctgctgacctctttcaattttttttttttttgaggtggaatcttgctctgttgcccaggctggagcacagtggcatgatctcggctcactgcaacttcggcctcccaggttcaagtgattcttctgcctcagtctcctgagtagctgggattacaggtactcgccaccatgcccggttactttttgtatttttagtagaaacggagtttcaccctgttggccaggctggtctcgaactcctgacctcaagtgatctgcctgcctcggcctcccaaagtgctgggattacaggcgtgaggcaccacacacggctcaaatttttgacttccagaactataatgtaatatatttgtgttatcttaagccactaaatttgtggtaattcattacagcagtgatagaaaaaaagttcagccaccaaatctaaaattatattctccaccaattgtgcacatgtgtatgtatttgcataaaacacacatgcatgtgcactcacacaaaacacacacagacactccttatccctctgtcttgatttagttttcttcattcatctgaccaccaaaataaataagaaaaatagggcacatgtctcccacacgtacatacacacatacacacagagaaatgagatttccacgaagacactgatttgtggctatgtcttgtgtctctttttgtcactgttgagttccttgcacctagaaactggcctggcattattgagtgaatagagactcattaagttttgactgcatgctttatcttagaacatagacatacattctgttattatttgtacaaaatctctccacctgtcaactcttagcccttgaggtcagggacccatctctcttcctcactgctgtatcattccatcattagcacagcaccctatcctcccacaagagccccacgaacatgtgctaagccattgggccaacgctaccacattccacacatctgagccccagagttgtcagaattccaacccatcaagagacctcgcattttatttgattgcaaatatgtctaattcccggttcactcgagcagcaagaaaaaaaaaagccactcgagtctgtaatttacaaagcaaatctgcccagcagaaatattcatcttcagaagacagtgggattcaatcattttttaaaaggggaaaagaaagaaacttaacctgtttctcccatgttccagttgcatcgtttgcaaaacttttgaaagccctttgaggccagggctaatcattttgcttccaggggctcatttcctgaggtgggtggtacctttgtcaccaaggaaggaacgcagcaggcaggaaaactgagattgtggcagaagtcattcttggggaaaggatgtatgaagatctagtcaattccacccggcttgctaattagagtttcagaaatacagagatgctgtgtccctttgaaatccttagaatagttggatgaacaagcctgtcccctaagggaatgtgcaaggacgtatttaaattacgttatttttactttaaataaccaagtcgaaagagttggtgactggaagttaaattaggcaagtctagggataatgagtatgtattagacgcccctccttttccatttcctctctcatggatccatctcatccttgtctatttcctgcccaatctgtgggcctctaaaggataaggaccatgtgctatttgtctttgcatttctggcagtcattatagtcccatgatagtgcctgacacatgctagacactgtgttgaattcttaaatagatgcccagatgaatgaatgagcggatgactgaatgaacagatggatagatggatggatgagtgtttgaaactggaaatgagtatgcctgtaccaaatgcctgtgtcccaacttgcttgataaccatccaggatgtttgttttatctacagcttctcaggcccctccccaagtggttctgattcagcctatctcaaagttaacctgggaatatgttcttgaacattttccccatgtagctccgatcatcaggcatgcttgggaaacacatgccatctccatctgtttcatgcttccttacctgaaatgtccttatgttttattcaccaccccagggtaatcttcagcaggtgaagtttctcacattcaaaatgggaatcagggcctcttcatgtctagctacttcctactccctctccactgccattcaccccttccaaatgcagtcttatttttctattctcactctcttccccagagctttcaaagatttctaacataagaccgagatagcagagcccccagggtcagcattctgcctgacagccgtgcagcaacacggactggattccctggaaggttttgcgtctaaaagcagggcctcgtggctctcaggattcccttgcatgcagcacccatccttcctgcccatccactgagtataccaacctaggaaatggaggagatcgaagtgtgtgtttactgtgtctcatgatgcatgttccatgagatggaagatggtctgggcagcgattttcaacctttatgaaccaagcaggctcccgggctccactcttctcaagatgatagggcggtatcttgtttttctaggtttcatagttagacctccctctgcaacatttgatttttttttttaaaaaagggtgccaaggatcaaaaaggctgaaaactgctagtctaaagcatcatttttgagccagtgggccatatttcgacctttctttctcaaggtgccattagaacaagaaggaattgccttttaggacagtgaactaagtactggagttcctgtttacacagaggtgattgaacaaccttaataattcttgcgttaataatctattgctggccgggcgtggaagatcatgcctgttatcccagaattttgggaggctgaggtgggtggatcgcctgacctcagtagtttgagatcagcctgggcaacatggcgaaaccccgtctctaccaaaaacagtaaaaataaaaaataaaaaaaaattagccggatatggtagtgctcacctgtggtcccagctactcgggaggctgaggtgggaggattgcttgagctggggaggtggagactgcaatgagcccagattgcactactgtactccaccgtgggtgactgaatgagaccccatctcaaaaaaataaaaacaaaaaaatctattgcggcataacaaattaccccaaaagttaatacctacaaacatcaatgtttattatctcacagtttccacaagtgaggcacggatttgctgggtcctttcacagtttccaacaaggcggtagccaaggtatctgccgaggttgcaggctcaactgggaagaactcacttcctggatcactcttgtggccgtcggcaggaattagtttctttggggttacgggactgagggcctcagatcttctctcgctgttggccagaggctgccctcggttccttgacacgcacatctctccactgagcagctcatgacgtagcatctggctgccattagaggaggcaagcaagaaaagagtgcgggcaagatggaactcaaggtcttttggaaacctaatcttggaagtgacgtaccatcccctttgctgtgttgagttcatcagaggcaagacgctaggcccagcccatactcgaggggaggaaatcgtatatagacatgaataccaggggaccagtgggagctcttctttttttttctttgagacggagtcttgctccggtgcctggctggagtacagtggcccaatctctgctcactgcaatctctgcctcccgggttcaagcgatttccctgcctcagcctccccagtagcagggactacaggcgtgcaccaccatgcccagctaagtttttgtattttagtagaggcggggtttcaccatgttggccaggatggtctcgatctcctggcctcacgatccacccacttcggcctcccaaagtgctgggattacaagcgtgagccaccacacccggccgggagctcttctaaaagatgtccactgcaccttcaaaagctttgctatcaggtaatcctcggaagtaatgggatatgatgtggtcagccacacctgggttcaaatcttggccctgctacttactagtaccactactgttcataataacaataaccattcctgctattccttgttaagtactgtgcacatcttcacaagtgtcatttcatttgacccccccaaagcatccccttgagaaagtcctttgactatccccagagcatgaataaggaaactaaagattaggggaattcagcaactcaccagacatctcagagctacctctgtaagcagaaaaggccagattccagccacaacgcctctggttctgtgagtctgaagctatactctgaccactggtgtaattcctttgacctccaccaaccgtgaaacagagatgctaacactggtcttcaagggctagtgcagaggatgaggtaagtgaataaaatagtggcccatagtcagaaatcagtaaagggtaggtattttgtttaacaaacatttgccaagcacttcatctgagccaagcattgtgctgatcctgacttttcttttcttttctttttttttgagatggagtctcgctctttcgccaagactggagtgcagtggcgcaatctcggctcactgcaagctccacctcccgggttcacgccattctcctgcctcagcctctccagtagctgggactacaggcgcctgccaccacgcccagctaattttttttttttttttgtattttttagtagagacggggtttcaccattttagccaggatggtcttgatctcctgaccttgtgatccgcccacctcggcctcccaaagtgctgggattacaggcgtaagccaccgcgcctggcgatcctgacttttctcatacagttttgttcagtttccacgccgaccccatgatgtagctggagttaagtgcttacattgacttattcaagccaggctctgtttgagtgctttgtaaaatttcactcattgagccctcaaaatgaccttaggaagcaggtgcttggagcagatgccacaggtggcctcacccgtgtcactgcagggcacacaggttcaacttccagtctccagcacctgcgtttctttgccagggctctctcgggctggtgaaacttgctttatcctcatgtgacaagctgtgccacccctgctccggggacatccttcaacagatgaccagtgccccaggtcactcgtctctcctgaagaactatgagttgtgagttacacaatatctaccagagctgcccagagaaattcctgcctgtgtttcctctgtaggggctggcttcgtagcatatccttcgtgcctgccttctccctacgtgtccctgctcctctacccatgttctctgaaccttccaaataaattacttgcccccaaatccttgtctcagtgtctgcttctgaagaaatccaaatgaaggcagtgttatcatcatcatcatcatccccattttcaaataagcaaagtgtagcacagagaggttaattaacttacccaaggtcacacagctgggaagcagtgaagtcagaattcaaactcaggcagtctgactcttaacattatgcatagtgattacatttttaaaaaattcaacttttattttagccacaggaggtacatgtgcaggttttttacatgggtgtattacacccgggtaacaagcacagtactcaataggtcgtttcacaagccatgcccccttccctctttcccctctctggtagttttcagtgtctattgcacccatgcttaagtccatgtatgctcaatgtttatctcctacttataagcatttttctttctgactgagctgggtaaatggaggagaagagttaccttatggtgccaaggaaaaactgtctacaccaaagctctgtgtgtaaccagtggccgggcatgcaaatggttccatgtattactgcaaagaccagcactcttctctaatgaaaatgtcagctccccaacacagccagctgtgattccattgaaaaatgtgattacggaagccatgctaatggtgttaacatgttgcaaggatttctggtgtgcttgtaaacctaaaaccgtaattgccaaagagaactcgtctcccacaaatcaaacccctctgtattgacaattacatccggtgttgcacggaatttaatgcctaaataatgaagtcgaagaacaatgctggagcctgagcatttgaatatatttgattgattcatttctcgctcccatttaataacccacttagtcagtgacggttaagtgcaccagagagaaaacatttcacagattaataactagatgtgggtacaagctggcgctcccctaatagcagcacaaaaataggttatcgtcaaaaatctggatttaatgttccaaaatggggatttgtgcttttcttttatatggttccatacttattaccacaggctaatgaaacagaaatcaaaaatcaggagctaataaatgcaattccaggggagtattttttttttatttaataccttccaagaccgtgatctttgttcaagatctttaatgctcaaattacaatgtgtgaatattaagcatattcgattatgattgaactctctgaaaagctaatttatgaaccctgcagcctaacacatttgtgccatttaaaaaaggaatatgaccacagttcatttataccaatttctccagtacagagataaacactcctaaactgcctatatgaataaagttatgagactgtaactttattataggctgggatgtgtgatttctgtggagagatatataattaaatgatattgactccgtgtgtaaagcaactttggcagaaattttgcattggggaatgttctcttaagttcctttcttgctgttctagtgaaaaaaaaaaaaaaagtggtcagacaagggaccttactcagggcagactgaaaaaatggggcctcctccctagctgtaattctctttctgcaataatttcatgacctcttgtggaaaaatattttcccctaataaactcagttttaatacaagtttaacaaatccttatccctttatttgttatgagctttactatcttttattatgtttaccatggaatgcccaagccatcaggtataatgagaactgctttgtgtctttccacgtgtccagccagcctggaaggacacatcgatgacactgtgaggaagaataaggaacacgtttctcatgtgctgtgaaatactctggcctggagaggtcctggtccattcattctctgggttattgacttttgccacagcctaatttaaaaaaaaaatgattggccaggcacggtggctcacgcctgtaatcccagcactttggggggccaaggagggtggatcacttgaggtcaggagtttgagaccaggctggccaacataatgaaaccctatctctactaaaaatacaaaaattagccgggcatggtggcagggactcgtaatgccagctactcaggaggctgaggcaggagaattgtttgaacctgggaggcagtttgcagtgagccgagatcgcatcactgcactacagcctgggcgacagagggagattctgtctcaaaagaaaaaaaaaattattgcaaagtgtatatatgataccaatttggtaaaactgaaatgcaaaattaaaactcaggctccagtaaatattagggcaagactgggtaaaatgtaatgcggagatttacttctccagaccctacacatttattccagtgaaggcttttgactcagccccctggcagtcaagatacaaagggacactgcatccattatatgggttccccaggcaaagcagacattgcctggccctgagcatgtattgccactaagctataaagtgcaggtcagggacctagtaactactctccctgcccctactctgccacacacacacacacccacccacccacacacacacacacatatacacatacacacacacacacacacacacacacacacacacatacacacacacactccatgggcaggttccccttgagctcgcactgtctctatgcaattcagtaataaatttatttattactaaacaaatggtgccttcacacaaggaagaagacatctcttcccctagaggacacagccagagaaaacagcttggcaaacaaatcctggcttgatctcagcctctgtgtactcctttggctggatggtgcgcaaggactcggatttaattctaaaactttgtcatgcaaatcttgaatgaatggaaccacagagagacgggacggacatagttttcaacaatgagaacaatattagattccctgagggagtgtttcagtccttggtggaagccaagatacatgtctaggagaaaacagttctacagaggccaagataatgtggtactaaaatccctggtgggctagttcaaggctatctaatatggtagatgagctgagtgtgcttcacccagtcttcctagttctactactctcaacgagttcgtaatacttcaggatagatcacagatgctgggaaaccgttcagcaaagccatggtgcaagaggaaccattaatagatcaacgtctggcccaggagcagatctaccaggacctatgagagttttcttttcttttcctttcttcttttcttttttttttttttttttttttttttgagaccaagtctcacattgtcacacgggctggagtgcaacggcacgatctcggctcactgcaacctccgcctccaggttcaagcgattcttttgcctcagcctcccgagtagctgagattacaggcacacgccaccacgcctggctaatttttgtatttttagtagagatggggtttcaccatattggccaggctggtgtcgagctcctgacctcgtgatctgcccgcctcagcctcccgaagtgctgggattaaaggcatgagccaccgtgcccggccctatgagagatttctacccagggacaagaatggaagactggaggcctgagatattggaacaaattctaccttctctcttttattttcataaataagccccttttccctcatgttccctagcttgaggggcttgatttaaagagccactcgagcgaacccaagagcatagaaacaggttataaattatcaaggtatcctagaaatcatttggttgtatggagtgaaggataacatgagttgtagctgcttaaagagcaatgacagagttgactccctttggcattggcggaaaaaaagagaacgagaacagggagaattcgttcaagccctggaacttgcttatttgaagcaaccctccataatcctctgacactgaaaatccaaccagagacaccaagttggaatattgaactattttccaaaaacgtggtatcactcagtgggaaggttccttgttcctataaaagttccccccaaaaagatccgccctctggaaaagtccttaggaatataccaaatcctaaggcagttacaagggaggagtctttgttgatataattaatgctggccatccaggaagcagtatgcaaattatgactgcactgaatggacagaacctggaaaccaggacaaaatgccaaccaatgcctgtgcaataggttttaatcctcccattcctattttcactgttcatctgggactaaaaatgtcttcaccctcccactcaataagctgggagggaaggtttcaccatgaactagctgatacttgagctacagaaagtcagcctgtgcgagcaaagatcgggctgaacagaagctaattcctgccccaattcctagagttttgttcaaacctattgtattatggtcaacatccggaatgaacaactaataattgcagcaatgccttcagggatttttgcctgtttacatataaatagttctgaccagagctggccaccagcaatggttaatttaatttactatcccttggcaaaagaatagtcattggatttccagcacttttaaccttggtagacccttgggaaataaaaattagattgagagaaaattaccagtggtggagaacagtataaaagtgacaatgacatatataaacctccggcaggagtggaataaagtggcatattattgttcgctggctcccaaagttcaatatttcttgtgtgatttacacttctgccattgtctcaccccctggagtcattctggccactcggaagtctctcccaaaatgcacacccttgttactgtcagagaaggggcatattacctggctaagcagcaagaggtgtttagacaaagagccattagaaaatgggtttcaacaaataagagtttaaagaggtgtctggaaatatgagactgaaaatatatgggaaagaaaagtcgataatccctgccttcgcagtcgtgtgtgtgtgtgtgtgtgtgtgtgtgtttgtgtgtttaaagaggtgtctggaatgagaagcagatgagtgtcttgggtgttccaggctactggttgcacttcctctatagaattatgtcaacataatctgtgtgcaaactcagctctgattggagggtcatgatgctatctcagcctcactgaccatcagttggtgctcccactacatgaaccacctgtggtacacacacacacacacactccccacacacaattgtttctttttcctaaacctttgctcatgtggtgttatctgcccggaccacccttcctcccacctctgttttgcctgtctggctcctaacttgcccttgaatacctagcccagatatctcttcctctaggaaacttttcctgatcacctcctggccagatgtgtactttctttagtatcagcctcctgaatttgtcactcttattatttgcatcaatctacttatgtgttttttttttcttttcttttgagacagaatctcactctgttggccaggctggagtgtaatggtatgatcttggctcactgcaacctccacctcccaggttcaagtgactctcctgcctcagcctcccgagtagctgagaatacaggcgcctgccaccatgcctggctaatttttgtgtttttagtagagatggggtttcaccatgttggccagcctggtctcgaactcctgacctcaggtgatccatcctcctcggcctcccaaagtgctgggttacaggcatgagccactgtgtccgaccctacttatgtgtctttctatcccaccttcagaatatgtaatgagactactgtgaccttccaaaagaaaaaaaacaaaaacaaaaaacagaacatttaagcctggagagagaggtcagagtataaaacaaagaacagaggcaagaaagttaggaaactcctaagtaacatatccaactagataggattcctggtacaggcttttcttttattgcacataccacagttgtatttttattatatttgtgtgatcatctaattaatggacacacacacaactgtaaaggaagagattgtgtctcccttcttttctatatcttcagtacctagcacatagatggtaccttatagatatttatgtaattaattagtttataaattaataagcagacatataatggataagagagaaaaaagtagacataagctcataaatggggctaaattccaaagttcatttgtatgtgtctccatggcacaaggatagacaggaacgccacatagaaataatggatattgagttctacttctgataaacttatatccaagcctgggaaggtctgattctaagacttacctttaaacaaatattgaaactggcatgggatttctcttgcccaatagaacccaaagcccataatttactgaggataaacagacttacatgataaagctgtccagaatccaccaacaccttcattttacatgtaatgaggtggagcaagatggtcctcactccccagatggtgtaataacatcattagagagaggattgcatttgtttcggagacaccttgacttactgtttgggatagaacacaagaccccgaaagtcatgtgccagtcaccaaagtgccttgaataaaggcgatcacagtgaaccttgggttgttttcttcaccaagcactatcatgaacagaatttgtaagtttgaagtgaggaagaattgttctgataatagagaagagaggagccagggcattcctttgggtgttgggggagaaagacacaggagtgaagtaacaataagagacatgaggatttttccagttgctcgatctgggcaatgtgatataaactcgcttttatgtctcctctacattgtctttagtaaattaacgcttaactcattaaatgctcttctgtgagtgggtctttatgtgcagcaggggtaagaggggcctcaaagagaaggacaagtgaacagctgacagctaggtgtcaaaggaatgggggcaggattcctagctgagctcatttgctaaggaacccttggctagtcatagactgagccatttcaaatccatcagtttcatctctctctctctctcctatacattaaagatttcaattagccagttagcagggtactgcagggaaaagggaaggaagggtgagtttattctgatgagttgttttcaacatttactgacatctaatacatgtcaaacaatttacatggattatctcatttaaatttcacagcatgtctatgaggtggttggtgttatttttattatgtagatgaagaatggaaactcaggctcaaggaggtaaattgtcccaagttgtagagccagtaaattttagagtctggatttgaatccccatctatctttacaccatattatgctatctcttaaaaaagggctgggtggttgctaaggaagatggagggaaacatatttacactgatgtggggtggcggtgggaaatgatgccaccaaaattcaggaggattttcctgaaggtaactgttgttgccataaagtactttaatcctctagtcaaccaaaaaggtgccactggtgagatggataaccacggacttgtgaattgcaggacttaattttggcataattaccaaaggaagtcagacagtattgcgggaatgtaggctttggaatcaggcaaatcctcatttgaatcatggttctgatttattatctaaaacagttcaactctaaatttccctttagaaataataatcataaacataaatttaacaattagtcaaaagaagagctgctcttctgaatcagggaacaaccgtcattagagaataataactctaaatctttttcactgaattcacagcagccctcagttaacagaccataagagcttaatcttgcaattttcttaattcctagaaataaactgaaacctctggtgcctgtgggatgaatcttaattttgtggaggagactctgttgatattggtgactgttttgtgaccttgagcaaatgacttcacgtctctgagcctctggtctgtcatctgtaaaatggggataatcacatatgacagttaattttgtagatgatgtgagataatgcatgtaaagtcctgagcacagtgcctggcacaaagcaagcactcagtaagagggagtgatgaggattgggatgatgatggcaatgacaaaaacaatgatgcaacaataagaccaagataagacaatatgttgatgttgatgtggcagtgatggtggtaatagtggatgatgatgatgatgatgatgatgatgacaaagacaacagtgcaatgataagaccatgaggagcaatgagcaatcatcatgatatactgtttgttgctgctgctgatgttctgtttgttgctgctgctgatgttgtagtggtaaacaatacagagaagaagaaacaagaaggaaggaggaagggaaacataaaaaaaggatttgatatggtttgactctgtgtcccaacccaaatcttaccttgaattgtaataatctccacatgtcatgggagggacccggtgggaggtggtcgaatcatgggggtgggtctttcccatgctattctcatgatagtgaataagtctcatgagatctgatggttttataaagggcagttcccctgcacacactgtcttgcctgccgccatataagacatccctttgctcttccttcatcttctaccatgatgtgaggcctccccagccatgtggaactgtgagtccattaaacctctttcctttataaattacccagcctcaggtatgtctttcttagcagcgtcagaacagactaatacaggattaaaagaagaaagaagaggatctccataaaacatcaagtgcaactcataggtaactgggtttcacatgcccaaacctaaggtgttctgattctccaaccagaacagatatccttttcctgattagaggtgcaatgccaaccacatcaatagacatggtctctgggatccctctaaccccattcaccacctggttctctcttcccatcaaggatgaaaaagggattttttttttattctctgtgtgcggaggataatgcatctgtaaactcatcataaccccatagccagatgcttctgtgcagtggagccagcaccatcaaggctaacaaaacacagcatcaatcctcaagatcctagtttctgggtggactgagaccatgcctgggaggagctggccaaaccacttcctcagtgttatcatttatgaaaccaaaatgaagcgttttcaataattataaggacatgaagtagatgactaagatcatacaagcaaatgtgctccgagttcgttctttcaagtagtgaccatgaatatcttaattttttattatgatgaaatgtagaattatcctcatgattaaaagcatgacttttaatgagtcatttaatctctctgcatgtctccttgatgaaataataactttatgtagtagtaccaaccttataagttagaagcgagccttaactaagataatttacagagtttaacatactatctttcctatagtgtctttcagaaatattagctgataatattattactattatgtaggagacaaaaagaaaattttaaaatatacccaaaatacatatctgattatgtgaaccccctgcttcaaactcccagtgatttcctcccagtgctaaggatggaatccaaatgccttaacatagctagcaaagctctttatgacctggcttctgcttaactctcactacagagtaaaccctcctaaactgctctcacacctttcaggtttcaagtcacttccgtgtttgcactcttccatccaactgttggcccgcctagcacactcagccctcaggctgggggaactgccttcctccccgagcccacagccctttgagcctcccccatcacagtgtagttgaatgatttcctggtggtttatctgttacctcaactacttgggactgagatggtatattaatggttcttcctcgccgtctagcatagtacctggcacagagcaaagcccaataaatgtttgctgaatgaagggaggagtagtgtgattgatgttagcatgggacacagagaaggggtgtggcaggggaatcagagggagattgatggaggatgacacctgagcaggatctttaggaacaggcaagatttacccaggcaggtttttttttaaagcaatggcaatacagaaagagagaacagcatgggcaaagcacagaggtctaaccaagcatggcacctttggggcaacttcatatattcacgcagcactgcaatattccagagtaaggaaataagagataatgtttggctatgtgtgccaacaagataccttgtctttatcctgtaaagattaagcaatcattgaagaatttaaagtagagcactgatcagatcaggcagaagcatgagattaatgatcctgttaacactctttgatattttcctcttctttcttcccaccctcccatccttttctctcctttcttctatcttcttcctctgtcttctaaaatatatcctttcattttctacagtttgcctttacatggattttgttgaccccagatgttagaggaccatgaattaagccaggcaggactcccagcatcagtcaggattcaaggggataaaatttcattctgatgacccggagcactaatgaacacttctccccaacacgagtcctctaaaaatggtctgaaatgaggcagaaatagtacgttatcttgatataaagggaacacgttcatcacttgcttaaactaattatttgtctgagagtgacggtggcaacactgaccttttccaatgatcaaaacacttatttttaaatggaagatgtaactcttctcatccctcctctttgttgaaatgtctgacctaacctcattcagtgacgaatacccagaaaagcctgcttaacagtgtgattagtgaagttattctaagatagtgatgaccaaactcaaagtcctagactattttaagtgttcgagttagggtttaggattagagtttagcgttcagggttagggtcatggttaatgttaaggttacgtttgatagattcgattaggatgaaagttagagttaagaataaagataagggtagggctagattagagttaaggttagggataagatcagggaaacttctggagaaaagagaatgagattagagggcagctaagattccagccactcatatgtacacactccaccccaaactcattgtttccctatttcttttctgtttagtttcacttgaaataataataaaaggaatctactcttctctgattcatagacagggtttgaaactcacagaactagagaaactcccaagccatgtgtgagagtcaatgactgacaccacagtccatttttcaggaactcagtagtctcatgaataaaaagtatttagacttctgcagatgacaccccacttaccaagctaaagctgtctcagatttggcagaagctgccccatgacacagggtttgaggcagggatatggatcatccacttgcagaccccttgggcaagtggatgctctgtataactttccttcttgactggcaggatccagggaatatgaccaaaaatgggaacagggccatgcttaccatcttttgcagtaaatggaaataaggaaaatatttaagaatggctatagtcttagccaggtagaaaggccaaagaacaggattctggatctgagaggttaggcaaaaaccatttcatgaagccaagaatgtgggttgggaggagaattgatcaggcatggtaagtgaacctggagaaatttttgagactatggacctttataatagagcttggttcagcaaaacggttctgtaaagggccagatagcaatgctattttaggctttgtaggctatattcagcctctgtaataactactcacctcttgctctagaacaaaagcagtcatagatgagacatatatgaatgactgtggctgtgttccaataaaactttatttaggaaaatagatagcaagccagatttggcctgtggaccatggtttgttgacccttgtactagggtatttggagagcttgttttgtgaacccccaaagagaacagtctcctaagaattaaaccaatatagaaatcttgcagaatgaggacattagaaagcaagaccaaggctatagcattattagaaaccctgaatccagccatacctgaaactaactttctctggtatcctcatttacgtgaaacaataaatcctctccttttattgttattgtttaagtagtgtgagttaggtttctgtccattgcaacaaaaaaagtccttcttggtatacaatacacacaggctaacagaaaaaaataatcaggtctcattacaaatcttctgattcccattccagtgctctttcatctcaacaagcagcagatagaaaagaatgccctagttgagatatcttttgtagccaaacatcagtgttgccaatgtgaacctagagtttgctccaaaacattcctgcttgttggagtgtcattaagggaaagcgtgtgcctaggaaatgctgcccgcggatgaagaaagttgacagaacagccctgaagggccagatggattccagacagctgtgacttgatggaggccctccatttggcaagaccagggagagcccagcatgaacgacatcaattagcaacctcttttgagagaggatgattacagcacaccactgcaatcaagcttcatgcagccactacatgtaacggttattgagcctctgtagaaacacacagacatgtgtggtatgatttttaaaagagaatagcagaatgcactgggattctcatacattcctgaagagattgtgaactggtgcaaactctctagaaagcaatttgacaataggtatcaaacacctttaaaataaaaaatctcaagacatttgatgcagtcgtcatccttcacccctgtaagaattgatcctgagcacatatcagaaatgcaaacaaagatttctgcacaaagatgttcatcacagcattaagtataatagcaataaaagaaagcgtacaaatgtcaaagttaggaaattaatgaaaaatattatgatacatagccataagatagaaaattatggcagccatcaagagtatgattaagaagagtctttaatcacatgagaaaatatccacactatggtaggcgacaaggcagcatacaaattgcatatataatatgatcaccagtaaatcaatatatggcatgagtttttatttttatttacccgggtacagtgatgacatgtttgagttgaaggactcagggctccttttatgggcttatttgcatggggatgtttggggctacagaagagtcaaggaggtaggagggttcctagagggaggagaaaacaaggactattaaaggtatgtaataatgtgatgatgtctgatccctcactatgatacttttgaggttcccattgagaagttctaggcagaatttgaaagacattaaatgtcactcttcaacgaagcctttccattcccccagtgacgaggtcacatgcccctgatctatgctctcaaagctttttgtgtttctccttccaagcacataagagatattatcattgtctatttagatgatatgtgattctcactcagttctgcattgttgaatatggtagccactatacagagcatgtggctatttctatttaaatttaagtcaaataaagcaaaacttaaaaatgcatttctcgctcacactggccacatttccagcacacaatagccacacgtggcaagtggccatcatcatggacaagacagatacaaaacgtgttcctcagggcagttttattgaacagtgctgtccaagactacaatgttatgaggtctcgctcacatgctattcctagttcctagcacaaatatctggcatattacaggcattcaataaaaatatatgctgaaggggccggctgtggtggctcatgcctgtaatcccagcactttgggaggccgaggcaggtggatcatttgaggtaaggagtttgagaccagcttggccagcatagtgaaactttgtttctactaaaaatacaaaaattagctgggcgtggtggtgtgagccactaattccagctactcaggaggctgaagcaggagaatcacttgaacctgggaggcggaggttgcagtgagctgagattgcaccactgcaatccagcctgggtgacaaagtaagactccatctcaaaaaagaaaaaaaatatatgtaaatatataaggaatattaataatattaatatatattaatgaaacattaatattaatatatattaataaaatatatcaatattaacatatactaataacatatattgataaaacatatatttatacaaatatatatttaatatatatttatacatatatatatatttaatatatatttatacaaatatatatatttaatatatattccttccttcagcatatctgtggagatgactttataaaaaaggaggtcctcagtacaggaagaggaaacacacacacacacacccctcagatatgttcctttttcaaataaccagcaccattaagatctcatgaacgtatttggtagggaataaacacaataaataatgatgatagaattctgagctctgagtaggcattcaaacaggcaggatggatcctgaccgtgagggtgtctgtgatgacataaatcatagcagatccaacatctcaggaccacatctgacctggaagcagcatgaccctgtcacagggactggagcacttggcaagacagagctcactgaggagctgatggtggccagcctagtctctcatcaatgacatttttttttccctgacagctaaaagacaaaaggtttgcattcgtggccgtgtacgtggacatgagggttctgaaccttagggctctcgaaggcccatcccattcaacgtctctctgtctcctctgcccaaagaaaaagccaataattcaaaaacctcaatgtggagctgcatgaaattgttctgtaacacactttcttacctacaggaggggctcagataaatgttgaatcaacagataagtctgcagccataataaggaatgagatcaggtccttcacagggacatggatggagctggaggccattatcctcagcaagctaacgcaggaacaggaaactaaacactgcatgttctcgcttataagtgggagttgaacaatgagaacacatggacacaggaaggggaacaacacacactggggcctgctgggggttaaggtggggggagggagaggattaggaatgctgggcttaatacccaggtgataggttgatgggtgcagcacaccaccatggcacatgtttacctatgtaacaaacctgcacatgtaccccgaaacttaaaagtaaaaatttaatttaaaaaaggaaattacaaaaaaaaaacaaaaacaaaaacaggtaagtctttgtcttggttggatggtagttggtaagaaacagtcgcatattcattcaacaaatgtttattgggcactaactgggtgttaggaattattttaggcatttggaatagacctgtgaacaaaacagaaatcaacaaaaatgtctgccttcatgaaacttacacgccaggctggttttcagccccggctggatattagaatcatcagggaagttctgaaaaatctcatttcttgggacacagctcagagaaattctgaaactctatagttcaagatggggaatagggatatgttgttaggaagtttcccaggagagtcagggtacagtagcctgggagcctgggaaccactgttgtaaaacaatggttctcaaagtgtggtccctggaccagcagtagtggcatcacctgaaaacttgtagaaatgcaaattctcagctgggcacggtggctcaagcctgtaatcccagcactttgagagactgaggcgggtggatcacgaggtcaggagatcgagaccatcctggctgacacgatgaaaccccgtctctactaaaaatacaaaaacaaaaaaaaaaattagccgtgcgtggtggcgggcgcctgtagtcccagctactcggaaggctgaggcaggagaatggcgtgaacccacgaggcggaacttgcagtgagcagagatcgcgccactgcactccagtctgggcgacagagcgagactccatctcaaaaagaaagaaagaaagaaagaaatgcaaattcacaggcctctccccagatgtatagaatcagaaaccccgtgagtgggacccagcaagctgtgttttcacaagatctctatgggattttatgtgcttaaatttgagaaccattgctctaagcaaaattacctagggagatgagttttatgagacagaggaatcctcctctgcatcttttcccaatgtgcttctgccaagtcactaaacctggagaggcatcccaagagcagcctccccaggttggtacctgacagccacactgggttttcagcagctctctccagccactcaggacgctgccccacttacctaggctcctctccccactcagttccccgattagcataatccttcccagctgctgaggcctgcagactagacatcctccagttgacctccccatcataaactgagatatgatggtcccccacagctatctgaggtcttggtctcccatagggctgcacagaaagggtgcacattcatccaccaaggcatgacccgctgcggcacacacacacccagaacctcattttacacaacacacacaaacacatccctactctatcacacatgtaatgtcacaaacacacaatcacatattcagttacacgtacattcacatcctcttactctgttctacacagagacacacacatacatgcacacacaatatcacgggaccagtgattctcaaatgtatctaaacattggccttacctgggagctttaaaaaattctgatgctcaggccacagctcacaccagttaagtcagtatctctggagctgaaagccaggtacatatctggctttaaatctatccaatgtatatatttatcacagtttctttatccacttactgactgatgaccatttgggctacttccacatttttgcaattgtgaattgtgctgctataaacatgtctgtacaagtatcttttttgtattatgacttcttgtcctctgggtaggtacccagtagtgggattgctggatcaaatggtagttttattttcagttcttcaaggaatattcacaatgttttccatagtggttgtactagtttacattccaactagcagagtagaagtgttcccttttcacttcatccatgccaacatctattatttttttattttcttgattatggccattcttgcaggaataaggtggtatcacattgtggttttgatttgcatttccccgatcattagtgatgttgaacattttttcatatgtttgtgcccatttgtatatcttctattgagaactgtgtattcatgtccttagcccactttttgatgggattatttgtttttccttgctaatttgagttcattgtacatatggtggaatactactcagccataaaaatgaatgaattaatggtattcacagcaacctggatgggactggagataattattctaagtgaagtaactcaggaatggaaaaccaaacatcatatgttctcactcataagtgggagctaagctatgaggatgcaaaggcgcaagaatgatacaatggactttggggactcagagggaaagcggggagggagtaagggataagatactacaaagtgggttcagtgagtactgctcggatggtgggtgcaccgagatctcacaaatcaccactgaagaacttacttatgtaaccaaataccgcctgcttcccaaaagcctatggaaataaaaacttaaaaaaaaaaaaaaaaaaaaaaaaactcagggaactgtaaaaaaaaaaataaacaaaataaaattctaccaaaaaaaataacgtacccaagtgattctaatgtgcaaccaaggttgaaatctactactctacaccatggccttatggctaacagaaaaaagaaataagagggtgtcaatttcctttcacaatggaaggggcaagagaaatggagaaaactgaatttaaacgacttccaaacatctctggtggaatccccggagtcataaatatccagaccacttgtctggtgtttctcgtacacgtcccaccatgtctttttccatttgtggatgtccattagtcaacgaccactaggaacacactttcatcaaacaaagttgggtttattgatccaatgcattggaggaaatggtgcaccgtggagaaccatgaggcatcagtgtaagagactgagcagagcttcttgcaggatttgggcttgtgccgtacactgtggaggaggtttcaaggaagcagggattggatatgtcaggaagggaggccagttccatgactagggcttatctaggggtcaagaggaatgaagttgacctaaaactctactttatttattattattattattattattattgttattattgataaagaagcaggcataaggcaggaaataaagatattttatgattcttatgctttggacaatgttcttgcttttgtttgtgctcagacacaattatgggccagtcttgtgtttgtctttctccatcattagctgcagagtggtccttatctgacgtttatcatttgtgaaattgttcctgttcaggaggacagcgggagagactagctggacatgccaggccagctcccgcctgtcagcagctgcctttttctttcccctatctcatcctctgttctccacattaactctgtgttgtttctttgcttctaaaatgtgtctgcttcttccacaaggtgatgaagttcatcttttcaacgtcctttataacacatggcacagtgctaggcacatcggcgagggaactctaacattctgaaaagaacatgaggttttgatttggaatcagaagacccgctttcaattcctgctttctacttgctaagtatgcaatttgggcaagtggctcaatttctctgagccccagatggggatgataatccctgtctagttcactggatttccaggaaaaggaaaatgagacaactctgcaaccacaaggagttgacaaagcagcagattctcgagaaatgtgcaaagggtaagtcaatgaagagaagaggtgattggtttgaccaatacctttatcaagagttgcaaaggacaatggcttaagagacctctaaagatgccatagtggatacaggaagtcgaaaaacaggtggagttctagtcacccaggtgatccttcagctcttagaaatggccttcaagataagcaactagaggttgaatttgtttagaatgccgcactccagcagtttctgcacgcctactatgtgccaggcattgtgatacagatgtagaaaaaaaaattagagttttttttttttccccaaagatgcttctagtcttttgggagaaagaaaggtttcaacttgacataataaacaatagaggcacttacaaagtacagcacagcatagagcaaacaggagttaattttgtcagtggctgggcagaagaagagccactggagatggtagggaaaaaccaaagaaaaaggagaatgcttcagctgggatttggggttttgtttgtttgtttgtttgtttgtttgaagtgaagtctggctctgttgcccaggctggagtgcagtggtgtgatctcggttcactgcaaccgctgcctcccaggttcaagcaattcttctgcctcagcctcctgagtagctgagactataggtacacaccaccacgtccggctaatttttgtatttttagtagagacggggtttcaccatgttggccaggctggtctcgaactcctgacctcaagtgatctgcctgcctcagcctcccaaagtgctgggagtgcaggtgtgagccaccgcacctggccaagctgggcttttgaaggatggataagaggtttccaggcagatagatgaggaaatgtgaaggggaatattccagcagaagtgtgaggggcagtgggttcaaaggtacaacagtatgaactactctgatgtaacccgagatcttgaaacccatttataaataagcggtgatatgagtgggtatgagacagtcatatccaccccagctcataacaacattgtttagggcacagccctgggctcttcccttggcatttgtctttttagcagacattcagaagctaatttaggggcagctgtcaagagctttgagcttcacagaccatgtgagtgaacttcctctgggtaaccaaaacggagagaaatctggccaaatgtactggccagagagaacttccttaaaggatccttttaaaatacactacatacaattcagaggagcgggtacctcctgggtaccttccactggggtggatattctttccagctcccccttgctgaattcacaccatagccaactggctaatgagccacttgagccacgtccacatgtcagctgtcccagaagcagttaaccttgaaacaattgtgccccgcccccgccacaaaggcaagcatacagtaatgctcacttctagaatccctcttctgggtgaccgagggcctgatgaagacacaggtgccacaacacatataaagaggccatcttcattggtccaggctactacaacaaattatcatagactgggtggctttaacaccagaaattcctttttcacagctctggaggctagaagtctgagactagggtgttaggatgatcagattctggtgagagctctcttccaggttatcgacagctgactacgtgtcctatccccacttggcagaaagaggatgggagagtgctgtaggtcccttaaaaaagggcactaatcccattcatgatgctccaccctcacaacctcattaattagttcccaaaggctccacatcctaataccgtcatattgggggttagaatttaaaaatgtaaactttaggccggccacagtggctcatacctgtaatcccagcactttgttggggctgaggcaggcagaatacttgaggttaggagtttgagaccagcctggccaatatggtgaaaccttatctctagaaaaatacaaaatttagccgggcacagtggtgtgtacctgtaatcccagctactcgggaggctgaggcaggaggatcccttgaacctgggaggtggaggttgcagtgagccgagatcatgccactgcactccagtctgggcaacagagggagaccctgtctcaaacaaacaaacaaacaaacaatgtacataaatataaattttgagtagacacaaacatttaattcaatacaaagtccaatatacacataattaaaattggtatatgaacaaataaatttaactagaccttgactttctcatctgcatctctagaagtttacatattcaacttgggtttttagaaaagcatttaaccatctcactaaaaaaatgagagttatcagtttcagaagaatttaatattgagtgctgtgagagaagatcagagaaaatcctgattaggagtaggaagctgtgttgaggaagtcaggtcttcaagtcactgtgccatcctcaggcaccacctacaaggggcactcagcactctcagagctgttctgattcctagtctgaacttcccctcccaaaggctccacatcctaataccatcacattgggggttagaatttaaaaacgtaaattttaggccagccatggtggcttatacctgtaatctcagcactttggggggctgatatatctttcatatagctttccatttttcccacgctgcctttgacactcctaggtatcaacctcgctctgtgctctcctattatcctaccctcttccctctataaaccttaggcttaaaactacttccctgactcgatccctactgatatttttctctttttacattttacatcagcatcctggaggtataatttctagataataaaatgtatccatcttaaaagcacagcttgatgagtttcaacaaatggttattcacataaccagcatcccaatcaaaatacaaaacccaaatcggtgccctcattctcctctgtagtcagccctttctgtgactatagattaatgttcctgttctagaattcattaagaatggaatcatacagcgtgtgctcttttgtgttttgtgtctgactgctcttattcagcgtgatgtctctaaaattcatccacattgttgtacatgccagtcgtttattcttttttttttttttttttttttctggcggagtcttgctctgtcacccaggctagagtgcagtggtgcgatctcagctcactgcaacctccgcctcccaggttcaagtgattctcctgcctcagcctcctgagtagctgggattacagtcgcccgccaccatgcctggctaatttttgtatttttagtagagaccgggtttcaccatgttggccaggctggtcttgaactcctgacctcagcctcgatccacccgcctcagcctcccaaagtgctgggattacaggtgtgagccactgcacccagccctcgtttattctttttgtggctgaaaagtatttatttgtatgaatatacacattcatgtatccatccacatattgaaagatatttgggtttttccagtttttgagtagtacaaatgaagtagctataaacattcaaagtcctgcactgcctttgttctatgtgcgaaaaatagttctttcatatatattgtccagttgtctaacgtctcatggtgggcaagataatctttagttattatcaacaaattggcctccctgccgcacccagacctgctgtcctcatcctattccaggatgcgctgtttggctcaaccctaagaccctcctctcccagagaagcatttctaccaggcgtgccgctgccctaaaaatagaaaacagatatttaaaaatcagactttggtaatcaggttaacatcaaccaatgaaaagtcatggtgacggcatgcattccctgacacgatgtcacaagaagggcacttttctccatagtattcttcaccaagactgcaacaccaggttgattaatcatgagaaacccaaattgacaggtaacataacacctggccagtactcttgaaacctgtcaaggtcaagaaaaaacaggaacgactgagaaactgtcacagaccaaaggacaggaaggagacatgaccacgaagtataaagcaatatcctaaatggggtcttagaccaacaacaacaaaaaatgacattaatggaaaaactggtaaatccgcataaagtccagagtttggtggagagtaatgtaccagtgttggtttcttggttttgacaaatgtacattccatgttgatataagaggttacaaaagaggaaactaggtaagggaactgtctgtactatttttgcaacttttctgcaaacataaaattattccaaaataaaaaattaatttaaaaaatgtcaagctgtaacagtctcagcccatgatggccaataaagcaataaccctgagctgtggccgttgagtctaagcctgctctgctgcccctacacctgcattttctgagaaaggtgaatgacccctcatctgtttgcacttccggtttattttttctttgctctttgtccagatcttcttgggatttgtgattgttacatcactgcattgttaatacagccagaaatccttcccgtggcctttcccacaggttgggtgataaactgccccaacccaaggagggagagacgctcctttgaacaaagcagagacgtgttcacattcaattccagctagctccaggaagaggaagagaaagctgtgggggcacataccctccaaagttctttgggtagcattatggcctctaataccctggcttttccatcattttccctttttcactggaaagcaaagcaccccagagtgggtaaggctgccattttacaaaccctgcgccctgctctgtagttttatttcccaaggttaacgatccaaataaatcggccctgtcttgcctctgctaagctgcttgagaaatgttttatagtcaacatagatcagattggtaccttattcctttgaaagttgtcctcggtagaagttctcgctctacctaatgaaccaatattagtttaactacatgttattaattaaaagtggaattttatgcagaatctttttcccctactaaagaagaaaaaggaatattgtacttcacagattcttaacagaatagtagtctctggatttatgggcctcttttaatggacatcatgaaatatcttttaaggctatcctacccttagggacttcattcttcttccacacaagatctggtcacaggtaactctctatagcccaggtcatttagctttcatgtgtgggagaagacctttcatcttaggttctcaaccttttcttcatcccaaaccttttcctggtaagtcaacatgaattgtgtgcacaagaaaacaaatgccatgtctcctggccattctggccacagatttaggggaatgtctttatttgggttattccagaagtaaaccctgaaataaggattcaagttgcaagtaccttattaggaagtgctccaagaccacatgagcagggagaagtaagacagggaagcgatggaaattcatataaagggggtgttatcaggtaattcatacaaacgggttatgtatgaataagttatcatataaagggggtagttattagtatgggtaactggggcttatctacactggcatactctggatccaatacagaatgcacacctcggagtcatccaccagggagactgggagctgggtcttcattcctcatctttcaattgtcacaggttggcagctactcctggggggtgttaatttcccaaccctcctggcctccccttctagcctctgtccatgggcagagtggactccaatgatcaaagagagccttcaagcaaagagacacaggcgctggcagttgcaaattaggccaacttccagggaaactgtgagagctgataggagatggctggccaccagaagtacatgcaaatcagtgcaccaaggcagagatggggatgcagcccagccctccagccctctggccatgttggataaatcacgcttctgcctttagcatcaagagaacacctggcatgatttcagacaagatcgggcacgttcagggttgtatggccatagacacctggcatgatttcaaaagtgtgatgggttagtccagctccaggaacctgctggctggaagtcagcatgctgcctctctttgtgtggtcctaggtagtgacacagtagaaagatgatgagccagtaggactggttctgccactagtggttaccttaggaaagtcacttgacctctctgaaactcagtttcttctatctgtgattgattgattgacagatagatagatcgatgagactatctaagatgtgatctcattagtacttaccctgaatgaaagctaatatatctcatctataattaagaaagctagggtgtcctgtgttgctgagtcaaatgagataatgtactcatcaggctctgttatgaactaaatgtttgtgtttccccaaaatttgtaggttgaaattctaatcttccatgtgatggtatttggaggtggggcctttagcatgtagttttacatgaggtcatgagggtggtgctctcataatgggattagcgtccttctaagaagaggaagagacagaataactctctccaagaacacaaaccacagaaaggccatgtgaggacacagcaagaaggaaactgtctagaagccaggaagaggaccctcagaatgagggtctgcagaatgaatctgcagacgacttgatcttggacttctcagctaccagaatcatgaaaaatacaatctgttgtttaagccactcagtctctggtattttgttacagcagttctagctgacaaagacagcatcctacaaaagataaggtagtgttgataagaactccataaggatggcaaaaatacagcccaaagtaacccagggtatcctgggttactaaagatattgtaaccaatgtatgaaaatggatatgagatttcaggggttgtaagaaacataaatatcaaatggaactcatgatctttgtttggatcctggctttaaaaaaacaattataaatatatatttgaaacaaatggagaaatttgaacatggagcaacatattagatgatattaaggaatttgtatttattttgttaggtgcaatatggtatatggtactatggttttgtaggaaagtgatctcttttttttttttttaatgcagtcttgctctgtcacccaggctggagtgcagtggtgtgatcttggctcactgcaacctccacctcccaggtttaagtgattctcctgcctcaggctcctgtgtagctgggactacaggtgcccaccaccacgcctggctaatttttgtatttttagtagagacggggtttcgccatgttggccaagctggtctgaaactcctgacctcaggtgatccgcctgcctcagcctcccaaagttccgggattacaggcgtgggccaacacacccagccaatctcattattttggagatgcaagttcatatacgtagaggggaaatgttatgatgtctgcatttaatgtaaaataattgagtaaaatctggcaaaatgctaacaaatgctatgtggtagctatattcattatactgttttctctactttttatatgtttgaaaagttccataataaaaattttataatgttttaaaggaacttttaaaatatatttttcaaatatcaaaaaaagtagacagcacaattgggatttatttatgttgctgtattgaaccctagttcatttattttttattgaaaattttattgggataattatagattcacatgtagttgtgagaaataatagagtttccatgtatactttacccagtggtaacattttgcaaaactagggtataatatcataaccaggatattgacattgattgaatctaatcttcttccaaattcccttgttttacttgtactcattggtatctatgtgcatagtgaactgtatacaattttatcatgcatgtaaatgcgtgtcacgatactgaaaagttccatcactccaaggatccctcatgttgtccttttaaaaccacgcccatctccccttcttcaccgcccccatctctaaagtctggctcccctacttttaaaatttttgtcatttcaaaaatgttctataaatggaatcatatagcatggagcctttagtgatcagcttttcttagttggcataattccccggatatttatttgagttattgcatgcatcaaaagtgtagccctttctcttgttgagtcctgttccatgaaatctccctatcacggtttgctaaaccattcacctgttgaaggatgtctgggctgactccagtttgggggctattacaaataaagctgttataaatatttgtatacaggtttgagcatacattttcatttctctggcagaaatgttcaggagtataattgctgggtcatatgctaactgtatgattcattttatttttaaaaactgccaaactgttttccaaagtggctgtatcattttacattccccaccagcactgtgccagggatccaggtttcccacaaccctgtcagcatttgctgttgtgactactttttattttagccttctgatagatgtgtagtgatttctcattgtcttaatttgccttcccctgatggctaaagatcctgagcatcttttcctgtccttatctgccatctgtatatcctgctctgtgaaatgcctgttcaggctttcccatttcctaattggactatgtttgttttgtttttactgttgaatcttgggagttccttgtatatttagatcctaacaccttgtcagatatgtggtttgtaaatattatttcccagtctatcatgtgtcttcacatgagctttctcagagcaaaagtttttagttttgatgagatccaatttaagctcatggattgttcactgttctatagtaatccactgtggctataccacaatgtgtgggccagaccaagtgacttcctgctaacaaatagaatatcactaaagtgatgagataattgaggttaggctgttaaaaaaaaaaaaaactgtgacatctgtcttgcttaccctctctcactctctcgctggttcactctaagagaacacagctgccaagttgtgagctgctcaatggagaatcccaggtggtaaggaactgatgtctccagccaatagccagagaggatctgaggctgccaataaccaggtgaatgggcttggaagtggatcctacccagtcaagccttgagatgatggctgtagcccagccaccaccgtgatcacagcctgtgagaaggactgaaccaggggtacccagccagttcccatcccaaagaaacagtaagaaaataaattgtctaattttaagcttctaagtgttggcataatttgctatgcagctaatacacacaatatgtcttatttatggccatttaagatgtttccattttttattattataaacagtgaagcaatgcggattcttgtagagatgtacttaagcacatatggaatagtttcttggggtgtatgcctggtagtgaaatttatttattcactatggaatatcaaatgcaaaattttactagattttaccaaactgttgtctacagtagttgaaacattcccaacaaaaggtatccccatttcgccacattctactcaacttttggtactgccatattgatgggtgtggaatggcatcatatttctcaaaaaaatttttgagatagggtcttgctctgttgtccaggcaggagtgcagtggcacaatcattgctcactgcagcctcaaaacttcgagactcaagtgatcctcccacctcatcctctcaagcacctgggtggaaaggtgcacagcaccatgcctggctaattttgttcgttttttttagggagacagggttttgctatgttgcctaggctgctctcaaatcgctgggctcaagtgatcctcccgccttggcctggaaaagagctgggcttacagataggagccactgtgcctggccacttaattttcaaatttaattaccctaattaataaagaagatctcagttcatatttatcggtctttggggtttcttcttctgcagattgcctgttctcatcattttccccttttccctttggttgtgttaaattgttaaattaaataagcaggaggccattggcctgaggctgtctctgtactttgagttcgtatgtaatggactacaacctaatttagcgtgtaaacaaaccaaaatataatttaggagtctattttttgtaacagagagccaggtctccaccaatcacaaacagccaagcctcaccaatcacaggcggccaaccgatcagaccatgtccaaataaggcaaagcccagctgtaacctatcaagctatttctgtattttacttccattttctgtctataaatactcactgcccactcagagatgagctctccaaacttctcctggttctgcatgctgtgtgattgctgtcattctttgcccaaaaaaactctgctagatttatttttgttaaaagtttttaacagttgtgtgtagttggaattgacttgtaggagttccttatgtctttaggaaactaattctctgtattgcaaatgtattctgctagtcactggtttgttgttacactttgcttatattgtattcaacatacagaagttttaaatttagtgtagccaaatttatcaattgctacacttcagggttctactttcttcatcttaattaagcaacatgtattttcccaagatgtaaagatattccactttagttccttctaaaagctgtaaggctttgcttttgttacatttagatctttgatccacctggagtttagaatatgatgtgacctaaggatgtactaagaaggcttttctgatttgataatcaataatcctattcatttaatactttttcccactgattttacttttctcctgctgatcttaaatgccgtctttgtcatacaaccagtttctctctctctctctctctctctctctccccctctttctctctctctctctctgtgtgtgtatgtgtgtgtgcgcctgtatgtgtgtgagagagaatgtgtgtgtgttatggggttctagactctgttctgttcacttcattagtttattgtctatgcctgtgccaataccacagtttgttaatggatatatgttttgaagaggttttgatatcaagtagaaagagccccagctctgttctatttctaaattatcttcccttctctttgcccattattcctctgtatggttttcagaattggtttaccaaacaccaccacaatcattgtttggattttgatggataaaatttattattgtgggggggggagtaaatttgcataacaataatattgagtcctcccacaagataaaaaacatcctaagcagagaaaaatcaattcttacaaaacatctgaaaatggttgtattttatgccctcatccaagcatgtaaagactgtctatagagcacctgctaagcttgaacttggctctctgacctattatctatgtacatttataacaactcccagctgtccatcagacacccatgttagatgtcgaaatgtggttcttagtgctgtttgtcagtattctacacagaaacccaggaatgcccaaaccctttcctgccaatcagcaccagcgacctttatacacaaaggacaatagaagaataaaaataagaataccactgtattaagatcaaagcaaacacccaatatctcagtgtaataattatctgtgaaaagtttgaatcatgtagcttaagcattttacccaagcaagggcttctcctccccctctataatctaaatcttggaacaacttagaggtaagcagaagagagataaaggagaaagaagactggcctgaagggcaaattctggtctaacttgactaaccaactttaagctcagaagaggtaataaaaaaaaaaaagatggagataaagggtggcctgacattaggtctgtaacaagaatcacaagaggagagagtagagactaggattctgcctaaagtacacaatatccactgcatctagtaaaacagcactcaattaatattataggtgccaaccaaggaatagcacctcctccttccttgagtagagagttaggaagatggcaatggaagtgaacttggtataagcagatgcaccaactcggattccctccctcaaatttgttcacaggccattcactcactcagttgttgttcaatcatttatttctcaaacactgttaagtacagtcagtcctcactacccacagattccaaatttgagggatcacctgtcttggtctattttgtgctgctataatagaataccacagactaggcaatttacaatgaacagaaatgtattggctcatggctctggaggctgggaagtctgagattgaagcagctggcatctagcaagggactacttactgcttcatcccgcaatggaagggcaaagagaggaggacagagagacaaaagggaaccaaactcatccttttataaagaaccaactcccaaaataacaaacgtactcctgtgataagagcattaatccatttatgagggcagagccctcatggcctaataatctcttaaaggtctcacctcttaatactgttacaatggtaattcaattttgacaggagttggggaagggggtaaatattcaaaccatagcatcacctgcctactataatttatttatgatctttaaatgctttggaggtctttgcagataaatgaagaagaataaaaaagtttgaggcactcaacatacacattcccagtagaggttaaagcaacactctgccttcttgcttcagctctcctactacaaataaatgtccttcttgcaatcaacttagtcccatatttttgcatcatatatatgtgtgtgtgtgcatatatatatatgacgcacatatatatatatgcacgcacacacatacatacagtatatatactatatatggtatatatacaccatggattactattaagccattataaagactaaaatcatgtcttttgcagcaacatggatagaactggaggcctttatcttaagtgaaacaacttagaaacaacttagaaacagaaagtcaaatactgttgtgttctcacttataagtggaagctaaataatgtgtacacatgaatgtagagagtgaaataataaacattggagacttggaagggtggaagggtgggaggtaggtgaaggaagagaagttacttcatgaggacaatgtatatcccttgggtgacagttacactaaaagcccagacttcatcactatgcaatatatccatgaaataaaactgcatttgtaccctttaaatttatacaaatttatttattttcttttattatactttaagttctatgcagaatatgtgtgcagaaagtacaaggttgttacataggtatacaggtgccacggtggtttgctgcacccatcaacctgtcatctgcattaggtatttctcctaatgctatccctcccctagccccccaaccctctgacaggccctggtgtgtgatgttcccttccctgtgtccacgtgttctcattgttcaactcccacttatgagtgagaacatgcagtgtttagttttctgttcttgtgttattttgctgagaatgatggtttccagcttcatccatgtccctgcaaaggacatgaactcatcctgggaatatacccaaaggattataaatcgttctactataaagacacatgcacacatatgtttgttgcagcactgttcacaataccgaagacttggaaccagcccaaatgcccatcaatgacagactggataaagaaaatgtggcacatatacaacatggaatactatggagccacaaatttttttaaatgtcgtaagaggtaagactagattgggtgccagaaaacctggatttgagtccaggttctcctacacaatgaatctatttcttggatatatcatcaaatttatcttggccttcattccttcatctataagactgatagcttgccttctaagtcggaagactgtccaggagacaaaagggtgtcctttgcaggaacttcaatatgaatggcagctgctggagttatgtagggcactaccagtgcaggttaatgcagagaccctgcctccagcatgccatatttcctcattttcaatgattacaatggcatttgggttttcttcatctctgcaagcttaattggatcaagctctctccccaatgcctcagaagatgttctgtgtttctgtgctgatgtaggaagtttcttgacctgtaagatcctggaccttgataaatccattcccaaaataaaggccactatgtggggtttcttgtgagacagttaaaattctgctgattcctccctgactttactgccaactgcttttacattctaacagacggtctgaccttttcagagtctccgtttcctcttctataaaaagaggatatgcaacaattggaattccataccaccgggatagaacaaacccattacagggtggggacgctttctttgcactcttagaaagtttaaattcataacacatgctcctgtcttcagccaaagtgtaactccaaaattgtttaatttacatttaattatttattctgctgttttgccttctccagttactaatagataattgcataagaggaaatgaaatccaatacacaatagtagtgcgagatcaatttacaggcaaattcctggcttggaaacactgaaatgggacacaagtgattcagtacaaagcaagcagggagatggtacccccccacacacagccctttaattagatccttaacttatttaatgacacctctgggtctggaaagctgttattgtttaagcgtttaatgtaccatacaattcaggggaaggagattgggaaggaaaacgacaaaatgcttttaggactcaagttattggtgtgacctgcctggcatccccaagcaatcctggtgatgacattttgcgttctttcccccttctgtgtgtcagatattggtggaaagacgcttccggaaacgctgtgcagcaattgccctcaaaagtttattttacaacctagcaatgatgtatatttccacttcctgcctcagcacattcataatcaacaagaagtattgttttccctgcagttattcttcaccttgggtaaaaaaaaaaaaatcagagtccaagaagaatgggcaagaaatgcaattattggccaggcacagtggctcactcctgtaatcccagcactttgggagggtgaggtgggtggatcacctgaggtcaggagtttgagaccagcctggccaacatggtgaaaccccatctctactaaaaacacaaaaattagccgggcatggtggtccatgcctgtaatcccagctacttgggaagctgaggcaggagaatcacttgaacccaggaggcagaggtgcagtgagccgaggttgtgccactgcactgcagcctgatgacagagcaagattctgtctcaaataaaaagaaagaaaaaagaaatacaatcatttttctaaaaccggatgtactttattaccagattttattttaaatggaagataggagcttgctctcaataactttgaggtccccctcccgctgcggttgcctctaagcatgcttggtttcaactctccacgcattcatcaacctgtttccagtgcttgtctttctgggtgagggtataggaataaaatgcaacctccctatcagaacaagcatgtattctaggtgagcagtgtctggattcaatcatcttctttctgctcttctcactagagctgtttctattgccggcagtgtctcattcaatatatttttctgtctacatttagcttctccttgtatttctcctctcattccagttatgcattctttgtgaccttttccacatgaatcaaacaccagagattataggtaagagagctgaaaacacgggcgagaactctgagacaacttaatagaactctcagctggtaaagaaactcccacaggtaaagaaactgaggttcagggacatgtttgggccagaattgggactagacgccagggtatcccagcagccaactaatcccccctcactaggaataaatagttccaattttcctaacatctgaggttgagaggtggggcgcatcaactgtgacatgtctgagctgcatagaggatggggtattgtgttccaatgcagctttttctctgatggaaaacctgaaattcttcagagacgtgcgtaactaacgtaatcactgtctttgggcagggggctgttccctgcctcaatgttctcatctgtaaaatgaagaaaacaacagtattctcacaagaattaaatgatacaataaagataaagcatttagtatagttttttgtttatttgtttgtttgtttttgtttttgagatggagtctcgctctgtcgcccaggctggagtgcagtggcgcaatcttggcccattgcaagctccgcctcccgggttcacaccattctcctgcctcagcctcctgagtagctgggactacaggcacccgccaccacgcccacctattttttttttttttttgtatttttagtagagatggtgtttcaccgtattagccaaggtggtctctatctcctgacctcgtgatcctccggcctaggcctcccaaagtgctgggattacaggcgtgagccaccgcgcctggccagtatagtttttgatgtagagtaagtgcttaatagacgttagttatcattaaatcatcattaccatcatcatcatcatcttatcacttattgtttggagacctctgttatactttgatgcttgaatcattctgtaaaacagcagtaccgctggaagaattcttccagtcattcattgccagatatttatgtaaagggtaattggcaaaatagcacttccttcctctgcatggtgggaaatgatgcccttgttagcttttctttcctgctgggaaaatgctaggccataaataaacattgaaatatgaaatactcaatgaatgaatgaaaataacatgggggtataactagaaaaaaagtctgcaaaatgttataatcaactttgagttttaatatactattaacagtgacagaaataactacaaagagggctcacagaccagacaaatttcctctttggatggccaaacatctgcagtaactgttcttctttattcttctccttcccagcctaaaggatttggtatacctctgttaaggcctgaagatgtgtttgcctggagtaactacagccctctacaaacaaaaaatgaaagtcggaaagtgaagaattagggttgccagacaaaataaaggaagcacaactaaatgcgaatttcaaatagataagagaattattttagtacgtctcaaatactgcatgagcatctgttattttgatacttggttttgctttgttttgtttctaaatctggcaacccttcaaataatacccattttccctatttggcatataaaacataggtaatttagtagtctgtctggcagtgtctggtaagaacttatttggattatgaagagatgaaacaagaccactgtacagataatcagggatctccctgagaagaaatagaggtggcctccacaggctaatgaatccatcgcctgaaatcgtaccacttacagaacgggttaaggtttattttgaaagaggaagaattagaaaagacttagatttgagagagtgtaacatatttatagaagcctatttttatgaggtatttttagactagagcgttacctgattcccatggggaattctatgttttaataaactccaaagactcaataatgggatattatatttgtgctaatttcactatcccaatataccttagtatttgggatatggggagagatattctgacccaaaaaaattatgtgccagacatttaatacacgttacttcagctagtccacagaacaaccctgtgaaatataaattggggttcagaaagttgaaaactaactgaaaaatgtgtacataccatatgacctactaatgccaccctcggttatttcccctcaagaaatgcaaactaggctgggcacagtggcccacagctgtaatcccagcactttgggaggccgaggcaggcggctcacttgaggtcaggagttcgagaccagcctgggcaacatggtgaaaccccgtctctactaacaatacaaaaattagccgggtatggtgacacgtgcctgtaatctcaggtactcgggaggctgaggcaggagaattgcttgaacccgggaggcggaggtttcagtgagctgagatcgcgccactacactccagcctgggtgacagagtgagactctgtctcaaaagaaaaaaaaaaaagaaatataaacttatgttcatacaaacacctgtacacacatgttgatagcagctttacttgcagttgccccaaaatggaaactttattcataattgccccaaattgcccctaaatgcccttcgatgggtaaaaaactttagcaaactgtggcacaccgatacaatgaaatgctattcgacaatgaaaaagaatgaactactgatatacacaacagtgtagatgaatctcgaaggcatcattttgagtgaaagaaaccagtttcaaaatgttacctactgtgtgatttcgtttatatgacattcttgaaaagacacgaccatggtgacagagaacagaccacaggggttggcatggggattagagcatgactaatactaggatagcaggacggaggtttctggggtgatggaacagttctgtattctgattacggtgattatataaatatatgcctatacagtcatagaaccgtacatgaaaaaatcagttttactgtatgataatgttaaaaaataaaattaacttaaaacacagaactagcaaatttgaggattggcattcaaatcttggtcacttgaaccctgtaagaactccctaaaagcaactataagtcagttgacaacatgtttcaagatggcaaggatactgatacatacatatacatattatacgtatatacacacgcacacatacacacacacatacatacatacactacgtatgtgtgtatatatattcctcttccaagtgcttagcatagcgtctggaaagttctacaggaatagcttgaatttttggcctgtaatactctatttgcttaattgctcaatgcccctgccagctgggagcttgactaatcacctacgctaatataaagtcagtgccaatggaagctgtcatttttctgtccttcagctggaggactttctttttttttttttttttgagacggagtcttgctctgtcacccaggctagagtgaagaggtgcaatcttgactcactgcaacctctgcctcctgggttgaagtgattctcctgcctcagcctccccagtagctgggattacaagcgcctgccaccacgcccggctaattttttgtatttttagtagagacggggtttcaccatgtttagccaggatggtctcaatctcttgacctcgtgatccgcctgcctcagcctcccaaagtgctgggattacaggcgtgaaccaccgcccagcctcagttggtcatggttttcacctgacctttcccttgagcccctggctcaacagccccatgtcaatgtctactagtcacctcaaactcaacatggcctaaacagaactattgagttcctgccccctacataaaacttcaaacaaaaaaactccaaattaaagcaatttttctttcccatgtcagtaaatggcaccaacattcatccaggtgctcaagccaaaagctgaatatcactcttgattcctccattccctcacctccccattgccagctcatccacccccatcaaatccatcatcgtctctccatctttatccctctcatcctgatccccatcttctacctggaaaactgcaagagccttgtctttgacatcccagcttccacacttgccctgctatgggtcattttctgcagaatgagctggtgttttaaattaaaattgcatcatgccactaaagccctacccttcttcctttcatgcttcaagtaccactcattgcctggactgctatgatttgacccttcctcacctcactgatcctctttcaaatgtccctttcacataggcttcaggcacctttgcttttatactggttatcaaatatgccaaactacctcctactctagtgcccctgtcttcactgtcccctcagcctggaccactcttcccctagatcatggctagtttctccatttcatgaaggtctcaccttaaatctgacctctttgcatgcaacttatttaacctcccaatccagagaagcctctttcagatcaaagagcatttattattttcattaaataacctgatattcttatttacaagaataagttgtctgctgttctcctctggaatataacctccatgagtacagagttttcttctgctatagcctcagtgctgagaatgctgcctgacacctagtaggtgtgcagtaaatgtttaatgaatggattggaaagaaaatgcatgcaatgtatgcaaagaaaaaataattggggtatccttggagaaactctaaaagactgcgtaagtgggctgacagattccagaggacacatttaaagaaaaaaaatccctaaggtacaaaagatttcagaaaaaaactacagtccaggggcaaaaaatgtccttcactctctgtgttaaaacttcaaccccaaacacttgggagcttcttccctcaaccaatcaggtacctcctctgagggtaaagagcatggcagatattccaaaaatgaattagtatgtttattaggtcacatcccccgagacaaaccacttgtctcatcaaatttacagctgtctccaaagcatggaaaatcctctccaatcagcaagttacatgggccgacttaacatattgtacaatgttgatttatggtgacaattaagaacgtattaccaaagtctatttcaccattaacacccctggggactgaataacttctaaatcttccggctgctacctcccaaaaggcttggatcttggctaaggatttagagattataaatttaacaaaggatgaaaactgcaagaggagagtcttgaacagcaaataatgagtttaaccagcttctcaacttctcggtgagatttataacgccttcctgcctgagggcaaggaatcttttattttgaagtttatagcctctatcacttattgttttagctccagatgtgagagtctggcatttggatgggattctttttggaagccagtattcatcagttcagcaaatctttccttctgacagtctttttggagaacagtacagtgaccagaaggcaacgactgtcacttccaaagataggcacctactacttcaacaagttgctggatgtacagaccctgcattgcatattcatctgaccaaaaagcccaaggaccagacttctaatagtctgacatgaaataactctaggactaattggttccatggttctagagttggattctcaccagtggtgcagctgggtcacctttgtgatcaccagtaccagcaaagaaacatgagccaatcattatctacgtagggttgaactggccaagtttgagtgccaatcacatccaggtcacattttcccaaagtatggatcagagaccatcggaatcacccggggtgctttcaaaggaagaaaaaccctctataccaaacctacttaatcagaatctgtggaatttggagttaggaaactccattcttttttaaaatattatttatagaggtggggtcttgctgtgttgcccaggctggtctcaaactcctggactcaagcgatcctccctccttggcttcccaaagtgctgggattacagatgtgagccaccacccccagtcggaatctccattcttaacatgctctatagattattctcatgcactctaaattttgggaaactcaagctttgttgtaatgcatgcaacccaacctggaaggacaagtcacctactctgggtggagacctcaagtgccaccagtaagcatctctctgcctttcgttattttcttctgaaaatgtaactcatcctcagggccccatggagagaaaggaagatgaaattcctgaggagagttcatctctctgagatatttacctttcactggaccacccactagcataacatttctgtacaatcatgctcagctttgaggtgaaatacgtgtctacaaaatacttggcactcttcaggttgttagaatatttttagaaatgaaaataacttgagaactcagtaatgaatatacaatagaagcatttcaggtatcatgaggttggtggaagaaaaataattttactctatttataggcagaactatctatcctctctctgactctcccccagaggagaatcatatgaagtttggctcctaggacatgtattagggactggaaattcgtcccatatgtgagtccaaatttcaaagttatccagtaatgaggatttcagagtgtggcattttgccacggggtgaactgaccaccaagtgcaataagtgctacgtgcaagcatgcatacacatgtatacacaaataagcctgggaaaggtactattctgtttggcaggaattggcagagaatagtggttcaatgaacacaaagtttatagattccagtcaccagaatctatctatctatcttccttccttccttccttccttccttccttccttccttccttccttccttcctttctttctccctccctccctccctctgtcccttccttccttccttccttctctctctctctctctttcttctttttttttttttcttttttttgagatggagtctcactctgttttccaggctggagtgcattggtgtgatctcagctcactgcaacctccgcctccccggttcaagcaattctcctgcctcagcctcctgactagctgagattacaggcgtgcaccaccacacccagctaatttttgtatttttagtacagacagggtttcattatgttggccaggctggtctcaaactcctgacctcaagtgaccacccgtctcagcctcccaaagtgctgggattacaggcgtgagccaccgctcccggcctactctggttaccagcatcttaactataataatcaaaaagcatcaataaacatcagatattcgactgtaacatttctcttacaagttacagtttcacaacgtgacttggatgtgatatggcacactgatgtgactattgtggtgactaacatttgttgggacttttacatgtgtggtaggtgatcgtcactaccacgtacgagttaggtgaactttttaatcttcattttacagatgagaaaacaaaacatttaactgacctgccaagattatagaggagagaagtgagggagatagggttgaatccagatggtctcactccagaggcaacttcttcagtaaagggccacgtaagtaaatgttttagtctttgtgagtcaaatggtctttgaggaaaggactcagctctaccactgtggcatgaaagcagccatggacagtaggtaaacaagtaaatgtcgttgtgattgtgtgtcaataaaactctatttacgggcaccgaatttgaatttcatgtaattttcacatgtcttaaaatattactttggggttttttttttcaagtatttgaaaatgtgaaaactatcattatcacatggtccatacaaaaatgggtgatggggtggattttgcctgcaggctgtagtttgcagaccccgatctaaagtattgacccttccaagatttagatcctgccttttcctaccattttgtagttgtgataacttgagcaagtcatttaacttctcagtttgcttgctcttagtcacttaatcttttaccttgatcgatggtatgcagtcagctattcatacattcatatattcatttaacaaatatttattgaacccatgcactgggctagatactggaggtgctagattttgtccctgccctccctgagcttacatttcagaggaaataacagataaataagtaagtatcttactttcaggacaaccaaatagggtaaggagctccaaccctatcaaaggcatcatggggaaattagaaagtagagactttttggacatgggcagttccatgccaggagggggacctcaaatcatactttcacctctcctgccctagactgatcctcttgggagagcactgaattatctaaattacagaacctagtacattgctctaattctttgacaaaagatgaatttgtttttcattgccatgttacaagttatcatacacttagcagcttaaaacgacatatatttattatctcaagttttcacagatcaggagtctagacaggcttagctgcctcttctgctcagagtcctatgaggctgtcaatgaggcatcagttgggctgtgttctcatctagaggtttgagtagagaaaaatcagcctccaggttcattcggattgctggcagaattcattttcttgtggctgtagatctcatggtggcttgcttcttcgaggccaacaggataatgaaaatgagtgttctcagagtcatatatgtagtaagatagtgagggccatgatatcccatcacctttgccatacaatataattcaatcaagccagtgacatcctatccatcacctttgctgtattctgttggcaagaggaagtcacaggtcctaccacatggaatgagaggggatcgccaagacataacactagaaagcggaggtcactggggttgtcttggaatcctacctgccataaaatatgccatctgaaacataggaccgatagtggtgcctgggtcaaagggttgtcttacatttaaagagcttaaaacagagcctggcacaaaggaagaatcttttttttttttttttttgggacagagtcttgctctgccacccaggctggagtgctgtggcatgatcccagttcattgcaacctccacctccagggttcaagtgattctcctgcttcagcctcccaagtagctgggactacaggtgcaggggcaggccactatgtttgggctaatttttgtatttttagtggagacagggttttgccatgttggccaggctggtctcgaactcctggctgcaagtgatctgcccacctcgacctcccacagtgctgggattacaggcatgtgccactgtgcccggccaggaagaactcattttgttttccttatcatctgccactatcattattaagaaggttccagccatgtctcacacagctcagagcatcctttagcctcttcaaggtgatttgggatactgggatactcctgtgcagagagcaacttcccttctctacctccagggatgtctatgcaacacttactgaatccacattacctctgacatcttgaacttctcacgctggacctaacagctctgtgccatctcattttctaggtggaaatgtttccttcagagatagggtatgtcaacttttgcccataacctctgagctcccaaattccaattttctttcattcaacaaattcatcttacaatcttttattgtgtgcctactatatatcaagtgctaggctttctccttctcagtaggtctgtgccaatccataaccccagaactttttctcattttgcctcttttaatttggcaaaaattaaaaattaaattaaaaaattaatttttaaaatattaaaaaaattaaacatttggcaaaaatctgtcgctttttcccattctagttaagattaggtttgtgttttaagggcattagctgcagctttgtgctgttagagaaatagtgcatcttattgacctgctctcttattttatagaactgcagagaactggcctggtgcggtggctcacgcctgtaatcctagcactttgggaagctgaggcgggaggatcacgaggtcaccagttcaagaccatcctggccaatatggtgaaaccctatccctactaaaaatacaaaaattagctgggtgtgatggcacactcctgtagtcccagctacccaggaggctgaggtgggagaatcacttgaacctgggaggtagaagttgcagtgagccaagatcatgccactgtgctccagcctgggtgacagagcaagactccatctcaaaaaaaaaaaaagcagaaaactaaagtttcttttctctcttctctccatatacacacatatatattttttttcctactgccttatctgccttatcctgccgtttagattcaaattgctccctgcctcctttctaagtgattcccctcaaaaacctggaaaattagttgacgggttttttttcttttttttcttttttctttttcctttttttttttttttttgcctctgatctcctagaaattcttttagcaagatttccctcaaactacaagattcaagtgattgtcactatataattagtaataatagaactattaataatgatgatattaataacaagtaatactgctagagctcttccgatattccagggtatgctctaagatctttgtacattttagcctatttaaccctcattttggatatcaggaaactgaagcgtagagaaattaagtaactcgtcaaaggtcacacgacttgaaagtgacagctgagattcatgctcaagctaattccaaggtctacacttttaaccactatgtaattttgcctcttcacatagaccatgagaaaaatgttagtggaaacagaattccatatccagaaatagactatgagaaaaatgttagtgaaaacagaattccatgtccagaaatatactttgaatccaaatgacagggcaaggtagtagggtaatacggggagaaaaaggaaaaattttaacttttcacccctatgaaatgcgactgagggtcaggtcaataggctgggctctatctctgatatctcaatgctctaaatattgcttttaccaaatcatcccagatgaagtgcaacatgagaaaaagtgatgctgaatccaagttaaaacagtcatgatgggagagggtatggattcgccagaactagagtcaaatcctagtctaagacttaatacccacttgaagattgggggacaagaagtgtatgcccaatttcatttgaggaaataaatgtctgttcctaaaatcaagctagtaaattacaaatggattctatgggtttttttgttttgttttttgtttttgcagttgcaagatttaatagagtgaaaacagagctcccatacaaaggcacccaaagagggtagctgttgccagctctaaggcctgggtttatatcccgatcattgtccctcctgctgtgctctcaggcgatagatgactggctgtttccttacctcctgttttcgcctaatcagtattttagtgagctctctttactacctgatttgttgggtatgagctaagttgcaagccccgtgtttaaaggtggatgtggtcaccttcccagctaggcttagggattcttagttggcctaggaaatccagctagtcctgtctctcagtccccactctcaacaggaaaacccaagtgctgttgaggaggttggctgatgaccactctaactgcttcctgatgaattggggcatagtaggggtcatgcagttgagatttccttgggaggggtgccttcggtgtcatcaacatcggagtgtgggctagcagaccagtccaggggtccatggtagatcttagtcatggactgcatctggggctccatttgaagaacctacaaatggattcttatccattaattagaacatgctgctatgtctaagatacatattctagatagtgatattatttattttattttatgtttacttatatgtattctagaaagggatgttatttattttattttacttctattgctttatattttttcaaggcaacaaaatcaagatatacaaaattataaataatatttaattattaaatattataatattagcaccaggtgtggtggctcacacctgtaatcccagcaactttgagaggccgaggcaagcagatcacttgagctcaggagtttaagatcagcctgagcaacatggtgaaaccccatctctacagaaaaaaatacaaaaaattagctgggtatggtggcaagcacttgtagtcccagctatttggaaggctgaggcaggaggattgcttgagctgtggaagttgaggctgcagaaagccatgatcgcaccactgcactccagcctgggtgacagagagagattctgtctcaaaaaaaaggttatagtattagtactcaacatgggaaatttcacttcatttcttttttaaaataattaaaactttttttttttgtaatatttggcaggagaatccagtccatttattcagcaaatagttacttacattgtattagtccattgtcacactactgataaagacatacccaagactgggaagaaaaagagttctaatgggacctacagttccacatgactgaggagccctcagaatcatgacaggagatgaaaggcacttcttacatggcagtggcaagagaaaaaatgaggaggaagcaaaagcagaaaccccagataaacccattagatctcgtgagacttactcactatcatgagaatagcacaggagagactggcccccatgatttgattaactcctcctgggtccctcccacaacacgtgggaattctgggagatacaattcaagctgagatttgagtggggacacagccacactaaatcacacattcacaaggataatatttgctatgcttctacattgagccaggctctgtgctaaacccttggtctagaatgggttatctagaccagacccattctttaagcttcaggtgcttactctctactgagtattgaaccataggagactgcaaatattcaatcattttttacttataagaatggcaatttcctataatccaaccttataataaggaaatatatcaaatgattacacaaatggaagtacaattataatgtgagataacagccatgtaggaaaatgtaaggttctacataaatcaggaaaaagacaaaaggctagtttcggaatagtgttggagattcttcttttctaccccatgttgctttccaagtgcagagagttccattaatcaatcagtcctaacctccctccatcttcctcccctggaaaattagggagagaactgctgctgggccccttccttctccttcctcttaggagctaaccactacagaaaacctgctttgctctgttcctctatgcagtgtttttgttttgttttgtttttattgtggtaaatatatataacatacaacttaccattttaaccatttttaaggtacagctcagtggcattaagtacattcacattgctgtgcaaccattaccaccattcatctgcagaacttttatcatcttccccaaattgaaactctgttcccactaaacaactccccattctccctctctccagcccctggcaactaccattctgctttccgtctctataagtttaacaactttagatatctcatatgagtgaaatcatacagcatttgtatttttgtgactggcttacttcacttagcataatgtcctccaggcttatccatattgtacaatgtgtcagaatttcctttctttttaagactgaataatattttattatgtggacatatgacattttgtttcatttaatgacattcatttatcaatggacattggaattacttcctcctttggccattgtgaaaaatactgctgtaaatatggatgcaaaaatatctgtccaagtccctgctttcaattgttttaggtatatactcagaaatggaattgctgaatcacatgaaaatttcatttttaattttttaagaaaccaccatactgttttccattgggatcacacaattttacctcctcactggccatgcacagggttccagtgtttctacatcctcactgacacctgtattttcctttaaaaaaaataataaaagcctttctattccaaggggtgtcaagcggtaactcattatggttttgatttgtatttccttagtgattattgatgttgagcatcttttcatatgcttttcagccaattgtataccttctttggaggaatgtctatacaagtccttcatccatttttaaatcatgttttttgtttgcttgttgttgaattgtaggagtcctttatatattctggatatctttctcttatcatgtatataacctgcaaatatgttctccaattctatgggttgccttttaagtgtgttgatagtgtgctttgatgcacataagttttaaattttgatctattccaattgatgtatttttccttttgttgcctatacttttgatgtcatatcacgctgaagttttacaaaggcaggcccaccatggggcatcccggggggtctggtgatgcctgtgactaagtggtaagtctagttaattctggattcagtataaaaattttacccacagaaatgagccatattttccaacgtcagtttttctgatttaacaaagatgtattttgatctccatctgaatcactccttgactttttcttaatttgtttagtatcaacttatgcccccatccaaataccaaaaggaagctgggcatatgcggtttttggaacgatatctcaagaatgcatagaagttaacaatttaagggaaaagacaagagtagatcgttcaaggcagggcaatgaaaagagagtatacaaatgtcctatagtaggagaagtataatatgattttacaaaaacaccaaaaaaaagcctaataaaggccgataaaaagcacagagaagagaacaaaaagaatggggtgaaagatgaggttccagacaggagcacagccagggtcccacaccggcaggatcttgtagaatattgtgtctgcccttaactagaaagagttaagcctatgatccttaaaggtttgcttaccctcattcctgagcataagtaatgaaagcatcagatttcccctagaaggcgaagattcctattgaacaatacagataagcatgccattttgctgccaccaaagccttaggtcagaaatgctttaattggctaagaagattcccttatatcaaaaacaggaaaacaaaatcatgaaaaaaggcaacacaaattaaactaacaaaataaagtgcttggagtgggaagacatcattattattcccctaaaattgtccaaaaactaaaacaaaaaataatcttcccaaaatgcatttggctattagaaatataaacacttagctgggcacggtggctcacacctgtaatcctaactgggacgccaaggtgggcagatcacgaggtcaagagatcgagaccatcctggccaacatggtgaaaccctgtctctactaaaaatacaaaaattaggccaggtgtggtgactcacgcctttaatcccagcactttgggaggccaggacacgcggatcacctgaggtcaggaattcaagaccagcctggccaacatggtgaaattccgtctctactaaaaatgtaaaaattagccgggcatagtggtgcattagctgggcacagtggcctgtaacctcaactatgtgggagactgagccaggagaattgcttgaacctgggcggtggaggttgcagtgagccaagatcgcaccactgcactgcagcctggcgacagagcgagactccatctcaaaaaacataaaaataaataaataaatataaacactttgtcctagtctttagaaagggattagaaaaaaaaaagaaatacattgataatactttcctctgaacacctcaatcaacccatagtagctaggactacacagagctacattatctcgtttaactctcacaacttccccaagaggatgggtactaccattatccctattttgcagattagaaaatcaaggcattaaagaactgaattcccaagagttattctactaatgcataatgaattggttaaaaatcaggcttgtctgttgccagaatttatgttactaaccattataacagccttgtttgcacaaattctatcccagagaaaagaacaggcatctttggccagcttagagaaaggacccttccctaaatatgaggagattttcacattgtgttgtcccttcattcagccaattccagatcctgatgagagacctgaagagtatgcacagactctgctgagtgactgggaacactgagggggaaagggaagatggacaaactgtaaagaatgtagatccaatgagaagaaaaaaagactaggaatgaaagaaaggggaaaggggtcatcctcctcccaaaagcgtatccattttaattaagctagttatctgcagttgcttttttatctaaacattagcttctcccacctaaagattgaaatgcagaattaaagagaggtattttaaaataagattagtccttcctcattcgtttattctctaacattaatttacagagccccttctccatgccaggcactcgtctaggcagttgggatagatcagtggatgaaacaaatatcccttcctatgtaaagtttacatcctactgaagggagatagacaataatcaataaacaaaataaataaaaaatataaaatgttcaatagtattttttgaaaagttgattaataagggacatcaagagtattggaacaggaagaggaagcatagttgcaggagtaatatgtcctcattaaaaaagtcctcatgtagtgctcaagctgccccttttgtgatcactcccttcaggttgtttttagtcaagtattacctcaaacacattccctttcaagttttccttggtcctggcatcaggtgcaggaggacaatgacatcaactcattctcaaggctggggccaaaggagaccataatgtgtggcaggactgctgaatccaaccaagaagaggactgactctgtagcttcttttttgtgacttatccccagatatccctggatggaaggggaggagaaaaacccaacctgaggaagccagcccatgggggtacagacctcaacgtcaaggtggttataaagacagattgaaagaggaacccatgcctttttctacccacatttatcttcactggctgggagagagttagcctagacagcaagatcccatgggctggggctaaaagagtgtctcttcatccaaaaccatggatgaggatgaggatgatgatgatgataagatgatggtagtggtgatgataaagatagtgagggtaatgataatgacgatgatgatgatagtgattatgaggatatgatggtgatgatggtgatgataatgatggtgatgatgatgatgatgttgatgtgatgatgatgatgatggtgataatgaagatggagataaagatgaagatggtgatgataatgatgatgaagataataatgatggtgatggtgatgatgatgatggtgaagatggtactaatggtgatagtgatgatgatgatggtggtaatgagactgacaatgatgacaacaacaactattactatgtatcatgtcctgggcctagcactttatgaacactaaacaatcagcttacatgacaaaccaatgagaaaaatattactattatccccattttactgaggaagacattgaggcttctgagatacttatttttgtctcatagaaaataagtggcaaaagccagatttaactgtataacatctgggttccaaaatggaatcaggagagtattgatgggaatggagatacaccatctggtaagccataaaagagagacagagtagttggccaaatcaaagaaccacaaataaaagaaaaactgtaatattagatacatgatatagtttggatgtttgtcccctccaaatctcatgttgaaatacaatccccattgctgacagtggacctggttggaggagtttggttcctgggggtggagccctcataaatggcttcatgtcctcctcatggtactgaatgagttctcactctatttgttcacatcagagctgattgttaaaaggaggctggcacctcctcccttctaccttgctccctctctcacctgtgccacatccacaaccccttttgccttccaccttgattgtgaccttcctgaggccctcaccagaagcagatgccaccactatggttttcatgcagtctgcagaaacatgagccaaacaattttctttataaattatccagcctcaggtattcctttataacaatacaaaatggactaataccatgcatatttgctgccttcccttttcctcctgtttgctaaggatgtacattttctgggtctaagtagtgagtgacaggagaggcagattacagaagtctgaggggcaatgttaatctaaaaatataaactggaagcaagtaggttagcaagaccaccatgcacacagtggctgagttgagaattaaaagttctggatttgagaaagtagaggagaaactatcttgaggaccaatgtctcgagggaaacagggagaggaggctaggataaaggtctgctctaggttgtagatggaatttcccatgatatttgttgagaaacttcagtaaagatgtgaactgggtcttcttcattcaacttttctttcactgttggggctctttcctggtgtcattcattcagggaagatggggcctcccaactagctctccccagtcagttctcccttgtcatttccccccactttctatttttcagtctgtagccagaatgatcttttaagacatatatgagattgcctcgttatccacaacacacactttaaaacctatgcatcatgagagatttaaactcctgaacatggttgataaagttctctgtgatctcacctctgctacctcaccgacttcatctctttgtcatttgatctcttaccattcttcaaccactgcctccttttgaattcaccttgctcctggccacctcaggggctttgtatgtgttatttcctttgtttttagttaattcctatccactttccacatctcaactcaaacatcatctcctcagaagacttttccttgaacaccccctcatgaaccccagactccagcaggccttcctgtcatatgtctcattagcccttatgtttttcattgcattgttatcacagtttatgtgtgtgatccatgctctccttagactctcccctgtaactctcattaaagcaaaagagtattttagttactattgtatattcaaaaattagcacaatgcctagccccctccacccccaaacatgagaaaaataaatcgggaagagtggcctcgggtttcccgtcttaacctgagctttgagaaacatagatatccacaggaatgctcttgcctggtgtggtctctttgctgagaaaaactataagccaacaatgtaggggcttctgcagggccataagctaaatatgaataaaacatactttagaacatgggaaattcatgtcatataacagagtaacatctggtttcaacatcacttcattcatttaactacctgtgttgaccttggacaggttacaaaggtgatctgagacttttttttttttttttttttttgagacagagtttcactcttgttgcccaggctggagtgcaatggcatgatctcagctcaatgcaaccactgcctccccagttcaagtgattctcctgcctcagcctcccaagtagctaggattacaggtgcctgccaccacgcccggcatggcatatttttagtagagacggggtttcaccgtgttggtgaagctggtctcgaactcctgaccttggatgatccacccacctcggcctcccaaagtgctgggattacaggcatgagccaccgtgcctggccctgagactcagtattctcatctgtaaagtggggttaatgatagcccaggccttactgtcttgttgtgaggattcaatgagataacacatataaagggcttaacacagcacttggcacatgcaatactccattattaatggtagctatgccaaaccagataatctacatcagggctgtccaatagaacttgccacaacaatggaacattcttctgtgctgtccaatacgatagccattagctacctgtagctattaagcatttgaaatatgactagtgtgactgaggaacttaatttttagtttatggctggtggccaccatattgaattgcacaccactctagactggagtcttcactctctggttctgaggggtggtgctgtccctggtgctaaaattcttgatgttcagattacttgttcgtttcatgggcaaaggaagcactcctttgtaaatacctctgagtagcttccatatcactagacaacagctgttctatggcttctcggagaagcttgatgtagtcacaaagagtgagcaataagtcattcttactcctctataattccaaattctggttatggtaatagctagtacttattaagcccttgctctgtgacaaagtccatattagaggtttgtctcaatctgcttgaaattctctgaggtagaccccattacaatccccattttgaaggagtctgtttagaggtgcacaactcataagcggcagatcctggatttgaattcaagtagcctgattttggagtctgtgccataaccaccagctagactaccttctcatactatgttccagtttgtcaacaacagaaatgaactctatttcacttaaacagtaaagggattattagaagtttccccaattgctcacagaatcaaagagaaaattagactttgaaagtgggggaaaaaatcaagggaaaccaagtggccaaaatcatctaaactctcccccagaagagcccattaagagtgtctcagctgggcacgggggctcacgcctgtaatcccagcactttgggaggctgaggtgggcagatcacgaggtcaggagatcgagatcatcccggctaacatggtaaaacctgtctctactaaaaatacaaaaaaaaaattagccgggtgtggtggcgggcacctgtagtctcagctactcgggaggctgagtcaggagaatgacgtgaacccgggaggcagatcttgcagcgagccgaggtcgtgccactgcactccagcctgggtgacagagcaagactctgtctcaaaaaaaaaaaaaaaaaagagtgtctccacctcctctgcagctcgctgctttatgtcagtagcctgagattcaaggacctaggaagaaacatattattagctgaacttaggtctaaaaagcccatactctatcatccagagatcatgggaagcaaatactggccttccaggttctatagcagaaggagctgccaaggatatcttcaagatcagctataaatgattccctaaacatagtaaatgggttagacattgagtagccaaaaaattataaacatccactacctactacccttacctgaatccttataaatgttgtcattaatagcgtgtttttctttccaggctacaaggtattgcttctagccaagtaagcataatcaaagcccaggctcctcatctgagtatctttaaaccttaacagaaagtatcatttgggatttttttttctttaagtggttattttccatgctccaatcattcaagtgctgccttcacaattttctgtcatatgggtgcatcactgctctattatttgcttaatatttctcttcaaacagactctacattttacttgattcattttgaaaggaaactttatattactgctgagaacatggggttagcatactagctatatttcatcttctgatagtcattaaaataaacataaaactctgaatgttttttaagtttattcaggaaccatctaaaagcatcctctgctccagagacgctgctctaatacaaataaccaccttgcagttttccataaggttgcagtgatgtgagatggatagcaatgcccggagagaccaggggaagctcaatttttactaccagaattcagagtcagggatctctgggaaatctaccttagcattctctcttcttccttgtgtggccttaatcaaaccccatggttcttttgtttcttggcccactcaatgccagcacttgagtaattaacatgtaatacagccaagcacgcccttccatcacagacacacgtgtcctctgcactacccaaaatgctatttaggattaacatttatttccttctaaggaacagaaatcaaagtctagtttctcttgcactttctgtgtactgcctttatcccagacccaacaaactggcaggctaaccaaataaacacagaatcaaacaaacatgagccttcaaaacaaaaaaaaaaaaaaaaaaggaggcgaggagcacggggaagtggggaaagaggcaattctattcaggaatagactcttttctttccagttaaagcaatgagcacatctattgacacaacatagatccacctaggactacctttgccctgcaaagatataaatgctgcattaaaactactttctgtttgcatagaaagtcctgtaaacagacctgctgtgaatgcaaagcaagaaacccagctggaaggagaaaggcttttggaggaacctgagaaggagatgttagatttgtctgccctgtacaaagatttgctctcttctcatcttcctctctttctcccctgactcctcctcctctcccctcttccccgctcttcttcttttcctctttctcttcctcctacctctccttttcttcctccttctcctccttcttctccctttctctcctccttctccatcttctcctccttcctatttcttctggagtcgatgagcgagcaggtggccagaattcatggcctggaaaattctggatcccatcaacaaagatgctgtcttggaaaaaaagctgccatgctcgttttcccaaactgaaggagatgctctccacatctctgatcttgcatccaagaagtgggcagaccacaggaaattctttcagagcatttagccctaagttcccctgtttaatatagttgactgaattcattaatcaattaattagtaagtcacactgctccagactaatacatatgccaacgcagcaagagactggaaagacacaggggaaacgaggaaagtgaagaggcttcccctgcaatactggagtatttattttgagtgtagcgagttcagcaaacatctgtttattcagaatacgagcaaccagggaactcgaactaaccagaaaggtttctcagaattttaaaagaagagttgatgctcttaaccataacatgctcagcccttatgagattttgaagtgctctctgaatcaaaagatttttttcccctgtgaagttttacagtaaagtgtgttccaactttctaaaaatgagctgaaaaggtatgttttctgggactgttcccagttaagttggatattctattcaccaaataacccacttctcaaccattccagtgcacgtgggccaaggaggtggggaaaacaagatggaaaccatcataatgggcttatgctaggaaggctgtgttgtaatttaaagaatactgatctttgagtctagaaaactgcatggaaaccctagctctttggtttaccagagcagtgactatttgtgcaagcctttcagaacctcagctcccaatctgcatagtgaaaaaatcactttatctttacaaagtggctgtgagagtgaaataagaaagggtatgtatgaatgctttgaatgccatagcacagcactcacatgcaaggaataattactgtcatttataacaacacactctcaaccttgagttatcctctcattctttcttctctttttccttctctctcccgcttcctggggagcataatgatgtctgtgataactattacacatgaaaattacatctctccattagttctctttacagaataaatttcattgaaatccattaaaatatttcagacaacaagcctaccttgaaagtgttgttaatcactattttattttgagatgttagtctaagggggaaaaaaggggatagactttagccatttggtactaaggtggattttgttagaccactcctttcaaactgtcaccaaacagaaagatggagaaagaaagccggacaatcagcaaatacctggcaattaatccaaggtcaagatctctaatttgtttataaaggtggtaatgagttgggaagggaatgttttacctgaaattcagtatccacccaaatggcaagtttatactctgcttagtctcaaggtatggaaatgttttaaaactttttcatattattccttgagtctttagggattgagcctctggatggatggatggatggatggatggatggatggatggatgattatatagattatacagacagatgatagatagatagatagatagattagatagatagatagatagatagatagatagatagatagatagatagatagatagacagatatcgataggatagatagactcacatctataatccaagcactttgggggtcgaggtgggcagatcacataaggtcaggagtttgagactggcctagcaaacatggtaaaaccccatctccactaaaaatacaaacattagctgggtgtggtggtgcatgcctgtaatcccagctactcgggaggcagaggcatgagaatcacttgaacctgggaggcagaggttgcagaagctgcagtgaaccaagattgtgccactgcattccagcctgggtgacaaactaagactgtctcaaaaaaaaaaaaaagatagatagatagatagatagtcagacaacagatattgatagatagatgcagagataaattcagatgtagaaatgaatacgcagatgaattaaattcagatagagtatttctcctgtccatgagggcatgcaaaacaaagagaccaaagaaaaatatgcaatatggctgaaggaaaccaaaaaataatcttaccccaccttctcatttttaaaaggtaaagccctgaaaaggggattaacttaccccaggtcacaaagccagtactgccactgttattactaacagctgatatgcattagcacctacttgcactaggttttggacaaagctgtccaagtgtgatatcttatttaaccttcccaggacaatcagaatgctggtcttactgactagaaaactgaaactcagaagggtgaagccatttgtccaaggtcactcaactggtgagatgcagagacagacttgcaaccagaggaataccctgagctacactgaacctaagactcctggtttccaaactagtacaaggtccctttatatatttcaacctgaaattttaacctaaaatatttctttccttccactggtaattggaaaattcacttttgtaaatgaacttacaaaaaaataattaccttcccaaattgcacattctcttttttctagtgaaatctattgcacgcactgaggactcgttcagcaggggccgggctgccccataaataagtcgtgcctaggttgatctgtgtggctgtcactgtatatataatagaagagacagtgtcagggagcagccaacattcacctccttgagcacatgtttccaaattgcccttgacaggttatgagcagagcatttcaaagggatgcattaaatacagcacaagtgctttgagaatctgcctttctacatcctgaggctggcactttgatttcttccaattccgtttggtttcccacttcctacgagaaggaaggaagctgagagcaactcctggggcagctggtctggctgcagggttactcccctggcttgtgaatattagaacaaaactatgagttgatgaggtacatggtatctgaggctaataaatatgggttgaaatcctggctctacaatttactagccacatggccctcagaaagttctttagcctctcactttttcaactatagaatagaaataatagccctctcctccagaaggttacagtaaggataaaataagcatgttaataacagctaatatttattcagtattcattatgtatcaaacacttcactaagcattgaacatgtgtggattacttatataattctcatacagaaataggcaaaattgttatctcaatgtcacagatggggaaacggaggcaccgagagtttctctaactgccccattgtctcatagcaagctttgcaccaggctttctggctgcagactaaaactgcttagtgaccactctgcgagcagagagtgcctggcacatagaaggtgctcaataaattttagggtttttttgtttgtttgtttgttatttttgtcattgagttacctcgtaattgctcacctattcagaaagaacaagtgtcagtgtcttggggaagaataacagaattatcatttactgaacctcagatgtgtgccaaatgctttacttgtattttcttatttaatcctcacagcaaaactgcatgctggtcctattattcccattgcctggatggggaagctgagacactagaaggccaaggactctcccaaggcaaataggagagccaggattaaagtcccagtccatccaacttcaaagttcacaccacactgacaacctaaacaaaccctcgatgcttatatcatctaaatcaaacaaaccatttctgcctccccactttcatcatcgtcatgtaagtcacagattcttaaagtttactgtgcacacagatcatccgggcatcctgttaaatgcaggttctcattcagcaggtctgggagggagctaagattctgcatttctaagaagcacccaggtagacaacacttagaatagcgaggatgtaagagagtccttcaaccctttccatgttttctcactctttgccacttaagactcaagaggcttctgaggttggagactgagagaggaaattagttccaccttcttcagctctatggagtcagattttccaaagcacccctttccccaccaaaaccatcctcaccaccaatgtcaccatcacacacgcacacatacacacacaggccctctcaacctctcttgaatttttatgtctttttgacatgtggttgttgggcacatttcatattaaatcactccaatgtcaaaagaaaattcaaattgttactaagcatatttaactccaaagaagaattctaccataaggctaaatgcagcaataccagcaatttacaactgaatagtgccttaagtaatgataatgagcctgatgacatttggttgtacatggttaaatctttcgtaaaatagtccctctccactctcaaatttaaacctagtgaagtatttaaaaggttcttcataaagcactctctcttgccagcccacagttttatagctgtggttctttcctgtccagcctcatctcctgattctttcccacaataccctgttttcccagttgtgctggacttgcagatctttgatccccatgatcattcctactcagggccttggaccatgttctttcctcttcctgggctctcttctcccatctgtaattccctgcagatctctgtctcccaacccagagtttccttccatagagaaggttttgaagtcaagatacactcaaggactctgctcaccactccaagatattgacttcatatcccttcatatcctactctctatagtacatcaatccctgggtagaataaatgtaataacagtctctgccagaaggttacagtgaagatgttagtcatagatcacgtttgttcagtactcattatgcacccaacacttcactaagcactgcatgtctgtatcacgcatataattctcacaaattataggagaatacatcattctcatataataacccacatgtgtaacatgatcccatatagtatatgtaatatatgtatgtaatatacgtacatatgtatatccatccatatacatatacacacatgtgtatatgtttacatgcacacacatgtatatacatatacgtatgcacatgtacgtgtacacacgtgtatatgtgcacatatgtacatatgaatacatatgtataaatgtgtgtacatgtacatatgtaagtatacatgtataaatgtatacatgcacattttatctatatatgtagacatgtatgtctacatgtacatgtcgacatatatacatatgtacttgtattccatatatgtatacgcatatatgtatgtaatatatgtagtatatgtataatatatgtatatatgtaatatacatgtataatatataaccccatgtatgtataataacataatctcgtataataaccctaagtcacagatgaggaaactgaggcatagagaggttaaacaactggcccattgtctcctagcaggctttgcagagagagggcggtggagaagttaggagggacccatttgagcatatgtttcagaagtgcaagaaacaccagttgatgtggtccttcagggagacttgccagcaggagagaaaactagaatgaagagcagaataatacagtgagaagggaagaaggaaaatgagggaatccctgaccttaacaccaagcctgctattctccccagatcttcccacctactccttccatcactcatgatggaagtcctttggatgataaaatcacagagtaccaaagtggctcatctgacagatgaagaaatgaaggaccagagaggacgggtaacacagccagatggctgtgtgtttggccgcccctgcctttttatctgactgtaccatccagagaacactctgaaggactgtgaggcagagaaacaccacaaattctgccacagagcctcaattcactccaatccctttaataggtcttgttcagacaaccttgtaaagctacagaatatggtttctctttctttgatactggaagtgtcaggagtctctctggccatttatttgatgtagaggttgctaaatgttatggcaaatagccatatcaatctggttaatggctgagcattggtgttggctgaaaccttaagacctcaccaatgagaaaggaaaggtttcctggtctccagaccatgctgtacatgaatatctggaacaggaaagtcatgtggtgtgatggactctgtccctggagctaaggagtgttctatcttagccttgattctgttgctaacttgtgtggccttgaggaaatcagctactctctctgggaagctttcacaaaaaggaaaaagaggctaatataaatagcccagaacttgtgcatacagactttagaagcaaatgtaccctttcagaatttgctgatgcccatgaattccttctctcctctctcagtttactgtggctacagctctcatgcttactgctgtgtaacaaccgcaaaatcccagtgggtgcaacaagaagaatttttgtagctcacgcatctgcagttgcgctgatgcaggctcagctggcctggctgattctgtctaggcttggctgcagtggctgcctctgcttcatatgtgtctcattctcttccagctctgaaagatgatcccaggtagatgtatctcgtgataatgacagtgacacagtgacacagagcaggcagaaacatgtgaggccccttaagtcttagctcagaactggaacgctgtaactctcaccttattctactagccaaagcattacacacagccaagcccaaagtgaaaggtcggggaaatatattatactccagtattttggcacaaggagctataaagtcatgtgggatggggcatgcacagagccaatgaattaatccacctgcgctctttaacaggaaacatgggtctccactgggccagtttcctccctgttctgcactatgtttttcttacgttgtgcctccagttccccacctggaatcactcccccatccacctatctaaactctgtttattccacaagacccaggccaacagccccctcaaccgtgaaagcttctccagacccacagttggccacctgaactgttccaatcctctggcttgtgggtaggtgtctcctacctctctggccaactagcagctgacttgtagaagaccataagtaataagtcccatcaagtggtgctcactggtgggttaggatgcccgtgaagggggtgtggcattggtgattaggtttcctaagaagggagggaaacattgactatctcttctgtaactgccctgcccttagggagctgaatgatggcatttccccttctgggttcactgagtcagaaccacccctttgtccactggtcagggtgctgcactttgtcacactggccccggggcagccctacttgcccccttcagcttgtacatgcccccttcagcttgtacgaagacccttgattctccctagagcccacacctagcccatgtaccagggcagaaaagcagacatcatagtgaaagaggagagttcccttatccctctcacaaggcatgcagcaggggtgcggctcgctccttcggttgctcagctgctcaaacccctaggggtaccaggcagacaggcaggtgcagaggccatagggagcgcttttgggtgatcttctttactcagccttcagattctaatactaatctctttgtgaacgcccttagagacacagccagaaataacattttaccagctatcttggtaccccttagcccagggatgtgataaatcaatcccataaattaatttatatgtccatgtattaagttgacacacattacagctggctttagggttattaggagtcaagaataaaatacatgtcaagggacccattttctgccattgtgcccaatggatgagctttctttctacaccccactgcatctcccttagcctcctggattttcaaggtctcactgacctctggctacaggactaggcctggtgggtgacaaaataaacacagtcagaacctatgtgggaaggaacccacgtaggttccttcccatcctccagggccaatctctcaaagtccagtcctaaccatttttttttcccaaagtcagaagcagccccgcccagcctcctgcatgctgggctatagatcctttcctcctcttcatgttaagtgcccaggacaattttgcacacacttctcagcggcggctgcagcagagactgtaaacctgtacgcagaattcattagctctgccgcaggtcctggtgctcaccttcctcagcactcttgtttctaagaggcatctgtgggttctggctgagtaaaaagaggagtccagcatcccctgatattcagccatggctccagtggccacctggagcacatcaaagtgggctcctgactttgcaggcacgaactagagcctggcagatgcatttgaggtctggccgtgccacctctgctcagagtacaatttaacagatttttttccatactgctctgggaagtggggacctatagagatttggtaattggcatcctaagtcctagcatgctttgatctctgcagcaccttgctgctctaattgcttagagacccattttcctatcccaagaccacaggccagagactctgcaataacctgaaggcaagagatattaaactgtctcattgcctctgctctgaagagaaagaagttttcaatttcagtcgtagtggcagggcaggacaattctagggatacctaggatctaagaagtttcttccataagtcagggctggcccatgaggacaagggattcaacagggttaccccccatgtggaatgggctggcttgggaggttgtgcaaattaacgggatgcaaactgatcatccgtcaagccagaaacctgggcattatccacagttctctttctttcctacacaccccatcaatcagcaagtcctggcaatgttacctgctaagtacctcttgaatctgttgcaccctctcctcattcccatgaccacagcttccgtccatctcttacccattttctgaacgcctctttccagtttgagcctccagccctctaaaccagggatcagcaagtacagcccatggaaggatgggaccaaatctggcctatcatctgcttgtcttgtaaataaagtttattggaatgcaaccatgccatttgtttgcatattgtctacagcagttttatgccacaacagcagaactgagtagctgcaaaagagatgaagctcatggagcccgtgaagtcaaaaaatgtgtctactctctggccctttaagaaaatgttcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggggtggtggcgggcgcctgtagtcccagctactcgggaggctgaggcaggagaatggcgtgaacccgggaagcggagcttgtagtgagccgagattgtgccactgcagtccgcagtccggcctgggcgacagagcgagactccgtctcaaaaaaaaaaaaaaaaaaaaaaaaaaaaagaaaatgttcgctgtctcctgctctaaaccaccaccagttaagttcatgtctttttctctccttcaaaattcatcaaccattcttcctgccaactaataaaatttgaaattccttgccacacatgcctcattctttatgaatgggttcttagctagttcaggaattataacttagcaggcaacagactttatctacttcgtatatttctattgtggcctaaattgaatttgaaatattaaattagtggccaactttttatagaatgataagactatatataaaaattcatatttatgacttatcttgaggaataggaaattctggcaacacctggcccttcattgacaatgagcagccacaatcaatgcacatccaccctctttaggtaaagccacagactccacctctcccctattgtcctacacctgtcctgcttcattcgtacaagcatgagtttgaaaagccctgctcttccttctttctctgccaatcggccctcttcctagaacagttttcctatagctatactgcaagacagagtccccaaagaagccgcgctccatcccacctccacattttcatgcacgctaccttcttacattagtttgctggggctgctatcacaagcaccaaagacttggtggcttaaacaacagaaatgtattttctcacagttctggaggctggaagtccaagattaaggtgacagtagggttgtctcttctgaggcctgtctcctgggcttgtagatggccgtcttctccttgtgtcttcatgtgcccttccctctgcgtgtgtgtgtgtgtgtgtgtgtgtgtgtgtgtgtctaatctccccttcttacaaggacaccaatcctatgcaattagggtccaccccaatgacctcattcaactctaataagctcttcaaggacctatctccaaagacagtcacaatcttaaatactggaggttagagttagaacttcagtatttggtgggaaggcacaattcagctcttaacatcccccttccatgagtgcctttccctactgtatttacctaaaaaatatgcattgttactccaggaatcagaccatgcacaacctcctccaacagcccctgcagggttggttttctatcatatgtttctttgcaacttacatacacctttactagagaactattatcttgcacttcaatgatttctattccccctttcttccactaaactgtcagcttctaggtggcagtaactatatttttttcatccctgtttattcaataaatatctactgggggcctaccatgtgccatgcactgctaaagccactgaagattcagcaacgaacaagacgggcaaggtccttgactatatgggctcatattctagtaagggaaaggaatggtaaataagtcaaaaagcaatcgtgataaattgcaaacactgtgcttaatccattgtaggtgttcaaaaagccttaaactgaatgccatggggagaatgcgttcatctgggaagaatgggagaagaggggtctaaaaccctgagaacattttcaaacctgaaattttgtgattttttctttactctgagttgctgagggagttattatgcagaaggtcaaagaaggctcccattgtcctgaaagctcatgtcacttaatgatgcagaaacttgggtcactgcatcccttcacctgtccttaaatcatgagacctcacagcatccctgagaagagacgtgacaaccaagacaaagcccaccaaatgtctcccatcccacggtctcaaaattcccacagccaggggtctgtttgccagtggacagacctagagatgaggtatattttcctgcattcaatttttggataaatttacggggcagtggagaatggggtaagggcgggtgattaggcctcgggactcgcactgtgtaaatgatgcccatttcaggtgcatcacagcccatatcagcctttaaggaagagaaggaccatttctagaaattctctagtaataaggcatggtatcagcatactgggactcgtgctctgctaaaagcacaaagcctgcgggagctcagcatggccacagtaatgtccattcccttcctatctgttgtccataatttttaaaaaaataaatgctatttgggtaccaatgtataaagttcatattgtagaatgtattaaatggattaaaatgcagaaacaaaattcatccgtggaactctgtgtcctcacatatttattcatacaaaatttagaatcatttttgtcacattaaaaatttacattacgtttgtaacaatgtcaaatttatagattaatctagtgggaggtggcttaggaatcccaagcatatcattctaaaatacatcaagtggtcttttaaaacactcagtacactttataaatatattccattatgtcctgcatatcaattatcttctgctaggtggtttctattacttggtaactacactcaatgaaatctttttaaatgataatattttctacctgattattgttggttaaaaaaaaaaggaaaaattcagccaaacgactaaaccctcttattacttctataagtttttagttgattccatgagattttctacatagatattcttatcattttaagtaacgattatttttccatgttgattccaagacttattcctagttcattttcttcgataattgccttggtgagcaattataaataaacaatgactgagagagcagtttgttcccacattcgatagaaatgtgtttagtggggctgggcgcagtggctcatacctgtaatcccagcactttgggaggctgaggtgggtggatcatctgaggtcaggagtttgagaccagcctgaccaacatggtgaaaccctgtctctactaaaaagacaaaaaatagccaggtgtagtggcacatgcctgtagtcctagctactcagaatgctgaggcaggagaatcgcttgaacccaggaggcagaggctgcagtgagacgacattgcactccagcctgggcaacaagagtgaaactctgtctcaaaagaaattctgaaaaagaaagggaaggaagggaagggaaggggaggggaggggaggggaggaagaaagaaagaaagaaaagaaagaaaagaaaagaaaagaaagaaagaaaaagcaagcaagcaagcaagcaagcaaagagaaagaaagaaaatgcctttagagtctccctgtattaacaggcataacattggttggctcttcgtttggtttagataatattttggttatgtttttaaaaatgcattttcagattcaagcctttattatcagtgagagatgtcagattttatcaaatattttcgattttatcagtatttaagatctgagatgatcttaagatttatataatactttcttctatgctacagattttcataatcctttattttccaagatgttacaggaccaatggtggagttatttgatcaaagatatgcacattggaaagtctttatgtgttttgttaaaccgcatccccaaaagattaggtcaattgacacctcgcccccagcagtggatgaaaatgcctgttatactgaactctcactagcaatgtgtttttaacaaccaaaatctctcttaatttataagactattgaatgttagatacaaaatacacaaggtatactacctctttcctatcctcttactgtacttcttaaaaagtgattgttggttctcaggtttatgttatctgctgacatttcatagagattttaacaccgttcctctggaagagctctaacggaatatctagaaacattttggggtcacataactctaatattctgaaaaagctattggattagggcccactgcaatgacctcatttaatccttcagaggtctataaggaccctgaagacagattcttagatattaggggttaggacttcaacacaggaatttgttgagtttttgtttgtttgtttttttgagacagagtatcactctgtcgccaggctggagtgctgtggcacaatctcggctcactgcaacctccacctcccaggttcaagcgatcctcctgcctcagcctcccaagtggctgggactacaggagtgcaccatcatgcccagctaattttttgtatttttagtagagacggggtttcaccatgttggtcaggatggtttcaatctcttgacctcgtcaacacaggaatttattttttgtttgtttgtttgtttgtttgagacagagtatcgctctgtcgccaggctggagtgcagtggcacaatcttagctcactgcaacctccacctcccaggtaaaagcaatccttctgcctcagcctcccgagtagctgggactacaggagtgcaccatcacacccaaatcttttgtatttttagtagacggggtttcaccatgttgatcaggatggtctcgatctcttgacctcgtcaacacaggaatttgaaggggagaaacacaattcagtccacaacatcccttttccaggaatgcccttcccttccttattcactgaacaaatcctcattcactcttactttaaacatcagatcgagcacagccttctctgacagccacaatttcttcccagaaaaatgtgcctacatgcaaatttttttcactagtttcagaagactcccagatctagcaggagtgtcacagacccacaaagaagaaatctgacctattttattatccctgttttacagataagaaagctaaagcccccccccaaaaaaatctgcttttcctaaaaactaaaataaaacaattttttttctcattttaaaggccttctcccacccccaaaagaaaatcgaggagaaaagcatatattgctttctacttaaaacatagatattttgattttgaaaaagaaaagtgctttgagaaacagtggcttgatctgagtgaacacagcgcgtcccaaggtgagcactttaagagggttcacgtccaatctcatggggtgaggtgggaaaagtgctgatcagggaacatgaaacccaagatctggtcctcacagacaacagactgaatgtaaatcctcgaataactcaaaagccccatgagcctcactttccacatccataaagtcgggtactaatgtttgcctcacagccacgttctaaggaataaatgaaatttctggacacataaggaaatgctatatacgtaggttgctgctatatattgttaaagattatttttcaaataaattcagcaaatacatatggggcacctatgatatgccaggcactgttctaggtgctagggaataaaccctagatgggagagttgggagggctgctcctctggagtttgcaatctggcaggcacagccaaccttaaagtggggatttgtattaggcccttcttgcagtgctataaagaaatgcctgaggctgggtagttaataaagagaagaagtttaattggctcatggttttgcaagctgtataggaagcatagcagcatctgtttctggagaggcatcaggaagcttccaatcatggcagaagatgaacagagagcaggcacattacatggcgagaacaggagcaagagagagagactgggacatgtagagggggagatgtcacatgcttttttatttttatttttattttttgagacagcgtcttgctctgtcgcccaggctggagtgcagtggcataatcttggctcactgcaacctccgcctcccggattcaagcgattctcctgcctcagcctcctgagtagctgggactataggtgtgtgccaccacgcctggctaattttttgtatttttagtagagacagcgtttcaccgtgttagtcaagatggtctcgatctcctgaccccgtgatctgcccacctcggcctcccaaaatgctgggattacaggcgtgagccacagtgcctggcctaaatcactagatcttgtgtgaactcagagtaagagacggctcacttatcaccaaggggatgacccaagccattcttgagggatccatgcccatgacccaatcacctcccaccaggccccacctccaacagtggggactacaattcaatttgagatttgagcagagacaagtccaaactatctcaggattcaaatgggataattgtcaggaacaaagaagtgcaagaagctgagggtgcttacagggacaggaaccaaccccactggaactggtcaagatgtcccatgtaaggagagtagagtaactgaaacctgcaggggaaggagggtttgtccagtaaaaggaagagggcattttaaggatcaggaattaagagagagctttgcatgttaaatgaacttttaaaagtccagtgtggggtgtgtgtgtgtgtgtgtatgtgcgtgtgtgtgtgagagagagagagtgttatagctgtgtgtgctgtgagtgtgtgcaggctgtaggtttatgtgtctgttaataggttgcatgtgtgtttgagggtatgtgggaggggttgtgagttgtgtgtgttgcggttgtgtttgtatgttgtgggttgtgtgtggtgtgggttatgtgcattgtaggtcacatgcatgtgggtgtgtggcttcatattctgggttatgtggtgggttttaggttgtggggagttgtgtatggagtgcggttatatgggggaggtgtgttatgcttatgctgcaggttgtatgtgtgtatgctgtaggttgcatgtatgtgagtatgagttttaggttatgtgggaggggttctgtgtgtgtatgggctgtgggttgtatggatgtgtgtgttgtgggttgcatgtatgtaattgtgtggcagattgtatgttgttagtggcattcattgggtgtgtattttgggttatgtggtggggctatagggtgtgagcagttgtgtgtatttgttgtgcatcagtgtggattatggagtttgcaagttgtgtatgtgggttgtggggtgtgagaggtgtatgtgtgtgtatgtgtgggtgataaggctaaaggggtaggctgagtcagactccacatgatatagaagacactgttggttgcccttcttcaatgaaagttgcccgacttccaaatgccagaacctgctctgctttgcctggggactttttctgggtctgggtccccccttgtccccactgtcagcagtgccagcgaattcacgctccccacccccagagtcctccaatcaatgtctgagcaggggtgggtggataaataccccagctccctcacccctcgggggagataatgctgacatgtgtgttctgtgccactcttcagctttgcctggcaggatttagctctagatgcacacagtggtcccgtgcttcatagcgaccctttattggttcttttccttcctgtttcactttcacacccctatctgggtgtttcctgagcccttcctcaaaaaaaagacctggtctcacatccgttacctcattggtctacttctaggccaacccaagctgagacagccatgtaagccatcctggacttcactctgagggcagcgggcagccatgagggttattgacaggggcatcccataatccattgttttaaaaaattaaatgaataaaacatatggttccagcacctttctatcatccacaattcgtgccttggaaaagggtgcctatagtccatgcacaaaagctccccagtcaaggaaggctatgtgcccacctgccaggccaaggtggtcccaccctccagcaggtccttgagattccagagcattcaggtgactcatctgagggcacaaagctaaggagccatcaagcccagggtgcagtcccagccacctgcacacctgcatctcagccccattctcaccaggatgcttctgcagtaaaaccttcaaagtcattttatccaaaccagttaagatcaggaccccgggccaactcaaaacctgtcagtcacaactgctgtttcgagaggacactgtcactttcacttagcctccactgggaaaatgaggaccaaagccatgtccctccctgggacgggagccaggggcctgtttcttttgcaagtcaggcagctgctcacaggcctacttgaaaggagaggatctgggcagttgtaactgtctgatcctgcctggcacagttctccaggggagcattgtccctgtcatgcgggtgaagcccaccgaggtcgtcactctctaagcatgacagacagacagtgcagctcagctggctcgtgctcctttgaaatttttctatgtcaggctcatccttcagtgtggatgagaaaggacagagctggagcctcagcagggctgggaagaggatatcagaatggtgtgcgcacacgtggaaagaaaaggaaattgactaggagatgagtggcccctggtccgatgggatggacaggaacacccccctccatgctgtgggggctgtcggtcccgccaagacacctgcttcctggcggtcccaggaggacaggcattgccagaaaaatggagtgtggtgcaaccctacatgtttttcctgtatatgcattcttaaatcacttaccctctcagtgcttcggtttcctcccttataaaatagggctaataatacctatttcaaagcattgctgggagacttaaatgagacagtgtgtataaacaccctcaggcagatgctattagatacgccttactttccccatcaaaactaacatttggagagtactcactacacaccaggtgctgtcaaaacatctttgctgttcaaccaccctgggaagcagatcctacaattcatcccattttagagatgaggaaactgagagaggttccataacattcacaagatttagcactcgcaggaagtggcaaaagttgcatccccggcagatctgactccagagcccgacctttgagcctttccaatttctcccctatttacaagggaaacagaaagcccacttttcccaggaagagcacttctgtgtcatcaggcatgggtcatgttcatcacccatgtatgatgtcttttaaggacataaagctatagtgtcattggtagtgtatttgatagctctggcttgaaaatcccataaatcaaaatcatgatgctgtacagcagtggttctcaaagcgtggtccacggacctcagcatcaacagtacctaggaaggtgtcagaaatgcaaatcccgggtcccagcccaggcctactgagtcagaaactctgggagtggagcccagagatctgtgtcttaccaagccttcctggtgacactgatggatactatagtttgagcaccaatgccatagtagagtacaaattttctttttcttttttttttttttaagacagagtttcgctcttgttgcccagaccggagtgcaatggcacgatctcagctcaccacaacctccgcctcctgggttcaagcgattctcctgcctcagcctcccaagtagctgggactacaggcgtgcgccaccaagcccggctaatttttgaatttttagtagagatggggtttcaccatcttggccaggctggtctcgaactcctgacctcatgatacacctgcctcagcctcccaaagtgctaggattacaggcatgagccaccgcgcccagcctagagtacatattttcactctccaataactacaggtcatgaaggaaattgtaaataaataaataaataataaattgttactgttttatttccaggtgggattggtaggaaataggagcagtggccatgttcattgagggttaacaagttcattcattcattcattcattcattcactcggtatttatttcttgggaactatacgccaggcactatccaggaaataataaaatgtagttaaacagacacagacgtgtgtggttcctacttttataatctaacagttcggtgaggggcaggggcagtcatgtaacaaaaatgacacaattattaaattgtgtttgtagcaagggctatgaatggggaaaggcatgaatctggaaagcagaatgggagcccccgatcaaatcttggaaaacctctcagaggaaatgacactggagtcaagatactggccagtgaagccagtcgggagttgggggaggcaatgaccgtgatgaggaaagggagcgagccctctagcagaggagacagcctgcacaaaggctcccagcgcagcaaaggcagggtgccctggggcagggaggggctctgcgggtgatctcaggtgcgcccccagtttctacgtgaatccctccacatccagctccctcaccttgtaatgggcaaagtcagaacatccacccacagggccccacgtgatttcggctgctcacagaggacacttttcccacctaaggccccagacacaagttcagcttcctcgctgcactcttaagccagcaggtggagagttttgagttcccatttccctggtggctaagttccgcgtgaagccgggagctatgcacacacaagacacgcctgggactgctgagctgaagctcctgttcattactgtagcttttcatttcctctttctttctgctgcttgaagctctgccttctttttcccaagctcagctacacttcttttacccaacacttctttgtaattaaagagaagcagtgagaattaatttgccacatcagctcacttcattgtattgatttttttaaatcccacccctcccaaaccaaatcaggtatcattgcagtgcacttctagagtatcttgtgcctcccatcaaaacctgaacacacaggatcgtaatctgtgctttaagcatctcctatctgcacccccaccccccaccccgccaagctgcaaattccacacaggtatgaactttctggcttttgctcatccatattcccagcacctaacccagtgcatggcacataataggtgctcaataaatgtttttgaatggatgaatgagttcattgttaaccttcacacaattctgtgaggtagactgccaccttgttaccctttttgaaggtgagaaaatggaggcttggcatgtttagcaactctctgaaggtcaaatatcaagttgcagatcttagattcaaaatctgggctgctacatcccaaagatcaatgtcttctccatgcatcacactgtctcttcaacaacccttaaactccagaagggcctaggtgtgtaggtgagtgcgactggacagaaaacaggaatgcttctttctgccttgagtcaagacactgtttgtatgattggaaatgaagggtgggagccttggtacatggaaggaaaattgggctggtgacagaatggggtgaatgcagacatccctgcacagtggcaacagggaggagatgctcttatcccagtaaaatttaatccctcataaaaatagcaccatatttggtagattgcatccctcctgtaatgcaaagagcagcaggattttccagatgaaaagtcagcttagactggtgcacacttgccctcagggctgatccctgaacacagagctccagagtgtgcaaagatggcctcttagggaccaaactgtcaccaggaaaatcacaagaagagaggccaacaattctctgtgactctcaatccaggagctccaacttaactatgtacgacattcaggattctgaaaccttagcaaatttgaaattatgattattacctcatcaacataacagttgagtgaagaaaagcagggtataaattgcatttcacgatgatttccaccttggttaaaagaaaaataaaaatatatgcggcatgaaaaagccccaaaattaaaggcaacacatgaaaagcttcaggagtagaactcagagtattttttctctctctctcattttctatattgccctaattttcattaatgaaactgcctctcataaataaaacaaaattccattttaaaggaatataatggtgctcagtacatgcttgttatatggccagttcattctattttacataacccgggatagtgcatattatcagcctcattttataggcgaggacattaggttcaaacagactgagtagcttgaccaagctgtagctcctaagtgcaaagccaaggtttaaaaataaattttgacctactctaaagcagcacttgccaacttggcatgttagaatcatgagaagctttttaaatcctgatgtccaggccacgccccaaaccaattgaatttgaatccttgagtgtgggactcaggcatcagtatttcttaaatgttctcagcaattataaggtgtagccaagattgagaactaatgctcacaagcctatgtcctcaaacacagtgctatattgcttctctatatacagaaatctattgtcatttgttgggaatatagataattattattgaaaaatcttaataccatcaaatattgcctaagaaccctattgatttctgagccttgtccacatgcccagatcaattcatggaaagagggtagccaccctacagaagagtagtagttcaacgatcagagcaaggaaaagaataatgatgccaagaatagatttctgaaggctgaacccattcagaaaggtttcctgagaaatccaaaatctgaacagaacaataacaagtaacaagatcaaagccttcataaaaagtcccccgctaaagaaaagcccgggtctgatggcttaactgctgaattctatcaaacatttaaagaactaatgccaatcctgatcccaaaaacagacaaagacatatcaaacaagaaaagtacaggccaatatctctgataaatattgatgcaaaaattctcaacaaaatactatcaaactaaattaaacaataccttagaaagatcatgcatcatgatcaagtgagatttatccctgggatgcaaggatggttcaacaaatgcaaatcaatcaatgtgatacatcatatcaaaagaatgaaggataaaaaccatatgatcatttcaattgatgctgaaaagcatttgataaaactcaacatccttcataattaaaaaccttcaaaaaactgggtatagaagaaatatatctcaacataataaaagctatatatgacagacccacagctagtatcatactgaacgtggaaaaacataaagccttttctataagatctggagcatgacaaggatgtctactttcaccactattatttaatacagtactggaagtcctagctagagcaatcagacaagggaaggatataaaggacattcaaagtggaaaggaagaagtcaaactatccttgtttgcagatgatatgatcttatatttgaaaaaaactcaagactctacaaaaaatctatcagaactgatagattaacaaattcagtaacattgcaggatccaaaatcaacaaacaaaaatcagtagcatttctatatgccaatagggaacaatgtaaacaataaatttaaaaaagtaatcccatttacaatagatacacataaaattaaataccgggaattgacttaaccaaagaagtgaaagatatctctaataaaaactataaaacactgatgaaagaaattgtagagtacaccaaaaaatgaaaacatatcccatgttcatggattggaagaattaatgttgctaacatatttatactacccaaagcaatctacagattcaacgcaatctttttcagagtaccaacaatattcttcagaaaaatagaaaaagctatgctaaaatttatatagaaccacaaaagacccagaatagccaaagttatcctaagcaaaaagaaacaaacaaacaacaacaacaataacaaaaacaactggggaaatcacattatccgacttcaaattttactacagagctacagtaaccaaaataatatggtactggcacaaaaacagacacatagaccaatggaacagaatagagagcccagaaacaaattcacacctacaatgaactgattttttacacaggtgtcaataacgtacaccggcgaaaagacagtctcttcaataaacagtgctgggaaaactggatatccatatgcaggggaatgaaactagatccctatctcttgccacatacaaaaatcaaatcaaaatggattaaagatttaaatctaagacctcaaactatgaaactactacaagaaaactttgggaaaaatcttcaggacattggtctgggaaaaaatttctcaagaaataccccacaagcacaggcaaccaaagcaaaaacagacaaatggaaccacatcaagttaaaaagcttctgcacagcaaaggatacaatcaacaaagtgaaagacaactcacagaatgggaaaaatatttgcaaactacccatctgacaagggattagtaaccagaatatataaggagctcaaacaactctacaggaaaaaaatctagtaatctgattcaaaaaaatgagcaaaagatttgaatacttgtttcccgaaagaagacctgaaaatggcaaacaggcatatgaaaacgtgctcagtatcattaatcatcagagaaatgaaaatcaaaattacaatgacttattatcttatcccaatcaaaatgacttatatccacaagacaggtaataacaaatgctggtgaggatgtggagaaaagagaaccattgtactacactgtttgtgggaatgtaaatttgtacaagcactatggagaacagcttggaggtctctcaaaaaactaaaaattgggctaccatatgatctagcaatcccactactgggtatatacccaaaagaaaggaaatcagtatatcaaagagatatctgcaacaaaaaaactcctgtgtttgttgcagcactgtttacaatagccagatttggaagcaacctgagggtctgtcagcagataactggatacagaaaatgtggtacatatacacaatggagtactatgccaccataaaaaagaatgagatccagtcatttgctacaacatggatggaaccgaagatcattacattaagtgaaataaaccaggcacagaaagacaaacatcacatgttctcatttatttgtgggatctaaaaattaaaacaattgaacgcatggacatagagagtagaagcatagttatcagaggctgggaagggtatcgagggtctggggggaagtggggatggttaatgggcacaaaaagaaataaccagaaagaatgaacaagacctactatttgataacacaatagggtgactatagtcaacaataacttaattgtacattataaaataacttaaagagtataattggattgtttgtaactcaaaggataagtgcttgaggggatacataccccattctccatgaggtgcttatttcacattgcatgcctgcatcaaaacatctcatgtactccataaatatatatacacccactatgtgttcacaataattaaaaattttaaaaatttaagaaaataaatagaaaggttttctggttgaccagttcctacaaagacaggaagaacttaagataagtaaaaaggagagaaagtgactgtggagaagtttcaataaaccaagtccagagtgaattcaaatcaactgcacccactggtgatagggtaccaggaagcagcagaggatgactgcttatttacacaactcaacaagaaggctcagaagaagaaactgagatccctggaaggacaagaggaacagatctgagactggttcacagggaagaggttgaagctaatgcatacatggatcaagatagaggttagagcaccaggtttgggaagaacaaagactaagctagctcaaatgatgactcccagcattaaggtaaacagaaaacatttctagaacccttgctatacatgagtaatttagattattgttcctctctccttcttactgtaggcaaggtatacttcctagtcccatcaatccgagttttggccgtgtgacttgctttggccagtgggataaaagcaaatgttgttgtgaatgaaagtttgacatgtgcttgtttgcttgggcttgccctcttgagcttcttccttttgctctataaagaataagtgttgggtagtggctggtccaagaaacaggagagatatgtagaacaagccttcaccaatccacagggttagaggcaagcccagcctaggtcagccaaactatagccaacctgccaatacatgcacaggaaatagacagttattgtggtatgccactgaaattctgaggatgttcattacatggtgctattgcagcaagagctgactgagacatgtgattctctccttgcatccacaccacagtccaggtaagtaagcactgtcactatttccattttatagaggaggaaacagtcttggggaagttaaataacttgcccaagagtggtaagtggcacacctgggtttctaactcagatcttcctttaaagcccaagcttaaaaccactaccctatgccacctccctgaaactttattatcaagagggctgaggactgcaacggcagagacttttccagggcttttatcagataccaagtcatagtgagagcaggtggaatttaagagccagagaacagaggacaccaagtggtcacagtgacattgctctgaaaacttttctctccatgaaatggcacagggacactggggttatgtttccaatggtcaagatttaaagggactggcacctccaaagctcttacaagcctttctgtcttaacgggagcataacacctccggagagaatgatgctgtgaggtctcagcaaaattgagcaccccgtaatacagggtttctcagccttcactctattgatatgtggagttgaataattctgtgttttggcagtatgtctctgtgcactgtaggatgtctaagagtatctctgggccgggcgcggtggcttacgcctataatctgagcactttgggaggccaaggtgggtggatcacgaggtcaggagttcgagaccagcctggtcaatagggcaaaaccctgtctctactaaaaatacaaaaattagctgggcgtggtggtgcgcccctgtagtcccaactgcttgggaggctgaggcaggagaattacttgaacccaggaggcagaggttgcagtgagccgagatcgtgccactgtactccagcaagtgtccccctaaggaggggggtgtaaattgtccccagttgagaactacagccttaatacatgaagcatatttaagaaaagtgtcactgagaatatcatgcaatgtcttgactcctaagcctggctacacattagaatggttggaagggttttgggaaatgcaaatccccagaccttgattggactcactgaatcagaatctctggaggagaggcctgggaccctgtgttttttaataaacttcccaggtggttctcttttaggcagcccagcctcagaccagggtctattatttgcaagtcatggtatagtcattataagcatggtccctggagccagagtagcccaggcctggaggccagcttgagcatttattaacactatggaaaaaatgtcatgtttcccagctgcatggcacttcttggacaatagctttcctatgtcaggggcatttcccactgatgagtcctgcctccccaaaagggcagccccaaaactcgctcatgtaattctctgagaatcagatgtgcttatgtgaaatatcaattcagaagcccaacatgtgaggaagatggcaccatgtagtgcccatctgtctggcaatggtggcaatggaggcaggtggctctcagggcatcagaactgtgtttagagtcagtaacaagagcttggtgcccctgcccagaggcggcaagagtgggatctgcaaagaccagccctgcagtggggtttctggcaaggccaacctttagccctttgagagagtctgcacgttccctggtagcactgaataaatttctttctgtttaaactagcttgagtgggttctgttgtctgcaaccaagaagagcgaactaacttcatccctgagtcttttttcctcatctggaaaatgcgaagcaatattaggaatataacatagcttggagggtaacattggtctgagtaggttcaaattccacttctggcattacactgttgcttgaggcaagttacatcagctttctaaaactcagtttccacaaagtacaatgaagacaccacaaactttatgaagtgtcttcaggatcaaaatggagagttgaaatggtgctttgcacatttcaagcccttgaatattaggtattgttactgttggagtagcgttgaaggctttttaccatctatacaccactaaaaaccttcgctccaggaaatccaatctccttcttgattttcagaagtcaagccattccctgaccactatgcgctttgcccttgcaggtctcttgcctgaaatgtcctccattttacttccacctatccatatctttcaacacctagctcacctctctccttcgagaaatccatgctatcacttcccctctttgaacctgcgcagcatctggcaatcccatagctcaccatagatttagtacttaattatgtattgcagtatttcacccgtatttcatcctgggtacgtcttgtctccatggctagactgcagacttctcaaaggcagattccttgcttcttatcctttgggcacccacactgtgttgggcacttaggaagaaagaaaagaaaagcatgtcatattgaactgaacagctgaacagatgccaaatcaatatctcaggtcacaggagcaggggcgggtcagcgatgaagctaggagtgggtctccctggacccctggttttcatgcagcggaatgactactcggctatttggaaatttgcatacagatgacattctagaaaatgcaggtgcctgccttttcaccacaaaggccaattaagtgctcttacattttaaaaggcagactgtttgagaaatgcctctgagaacaattaagagtacaaaacgtggtaaatgaaactggaagttatcaaaagctattgaaggcagctgagagaaatggcaacttacctccacatgggaggctatacagcccagtggatcagaaaccaacggccaccagcgcccagtccctacccagcctctctccatcgtgcatgcggcacgacttctccaaacaaaagcattctcaactgtgaagtagcgataataatagtacttgcctcatagggtagttgttaagattgaatgtattaatacatggaaagtaattaaaacagtgcctagcacttaagtgctgaatgactgttggttgctatgataatgattattaatagagtattacatatgttccaaaatagcggggacctttgctgccttgttttctcagcacccggcatctccagcacacaggaaggactcaatcaatgtttgttgaatgattgcattaaatggcaagcttagctggtgacaaattatgatccagatcagcttgcagacccactgcccaagtgccctaggctgctctttccttcccacaggcagaggctcaggagcccttttataagtttctttcaatcctcagccagcccctcccagctcatcctctcagtccctcctggccaagggtccatcccccaacatcagctctagttccagcatcttgtccagctccctttgaacttgatgctttgagccattcctacaatgcctgcttctaccttctgaaactgaatttttctttctttggcatttgatagctgctagtcatcccaccctactgactgggcctgcctagaaccccaatcctgatgctccccagtctcccatggtctggggttcaaacacctctgcatcccaagccctcccaggctccacactgggactctggaattttaaaaacttgggtttaaatcctgatattcagggtatttacttaatctcgctgacctcagttttttcacctgaaaagtgggataacaatacccactcattggcataagaattaaatgcctatagcatgcctaccacagagtcttccatcaaaggggatgatccaatgctaattccttctccagctgctacttctacaatatggcagactctctagagccccataaaaacacgggatgagccatttggccagcaaggacctggtgattgaaagtgtgagcatcaagtctatttctccaaaagagagcagaactttgtaataaaactgagttgtggtagaaagcaaggaaaagccgcttgctgcagccttaatgagcaagataaagggcacatctttggaggccaggggacaggtttattaataggattaaagccaggggtagctgctggagagtcagagtggcttatcagtgtgaaatagtgtatactcacagataagatcacccccagagcagccaagaggccacttcagaaacaaacaaacaaacaaaatgcagtgggatcctgcgatagggtaggaaaatcagtggtcctcaagttctgtaccataatcttctgtaagggtggttacatcagaatcactggccgggggtgaaggattgggggttaaaatagagaatctagaacccatccctagagtttatagtccagtaagtctaaggtgttgcctgggaatccattagcaagtttttttttaagacagtgtctcgctctgtcatccaggctgtagtgcaatggcacaatcatagctcactgcagccttgacctcccgggctcaagccatcctcctgctttagtctcccaagtatctgggactacaggcatgccaccacgactagctaattttttttaagtagagatagggtcttgctatgtggtccaggcaggtctcaaactcctgggctcaagcaatcctctcaccttggcctcccaaaatgctgggatcactggcatgaaccaccacacctggcccattagctttttttctcttttcttttctaaatcttagatgatgttgctgaagaagcagccaggttttggactgtttgaagattataattagttttgtagcaattcagatatctggatgcatacattcatttgtttaacaagtatctgttatgtatttatgacatttttggtgagcaagaaataagaagaaaagatggtcatgttcctcgtcaagtttccagttggctactggagagatcagtcaaagggtacaacaatcaatcattcgttcattcaaaacttaagagcctcctatatgccaggttctgtgctatggaagcaggattttgattaggcctttaaaaatgggaagcaacaagaaaagggagaaagtcttatctttgatttcagcctaaccaagggaggcatcactgtttccttcttcttttttctttttcagaacgacatcctatattactccctgacaggggtgaggagtgtttcctacagttcacaggaaacattatgcatccatgattccagtccctaggcttggaagagaggtctgcataattgagatatagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaataaacaagtaactgagttctcttactagaaaataattgtaaagtaacgtacaagtttgatattttctacacatggagttttaaatatgaagcagatatgaaggtattagtaaatagatcaaattatttaaagcaacatgtttaaactttcaaataaaacttaaacagaatcagtagtattcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctaaggagagataatttcagaacggtatcaatggcctccaaaatatccctgccatttgactatctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacaattttgaaatacacattattattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggaggagtatgttaattgacctgatttaattattccacaatgtatgcacatatcataacatcccattgtaccccataaatatatgtacttatttgctgattgaaaatgtttttaaatgtaagatgcagaagaatgtgtgctatcttttaaattttatggcatatggatgtattaactttttaaaaatttaaaagcaatatgtcaaactatttatagagtagaatccaatgatctatgtgggaataagaaagtttgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatgtggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgactttagaatagcttggtcctgttcactcatatttgttcttttctttttttttttcttagagatggggtcttgctctgtcacccagactggggtccagaggcatgatcatagctcactgcagccttgaaccctgggctgcagcaatctttttaccccagccttccaagtagctgggactacagacatgtgctaccatgcccagctaatttttttttttttttttttttttttttttttttttttttttttttggtctacagacagggtctcaccatatcgcccaggctggtcttgaactcctagcctcaagcaatactcccatgtcagcctcccaaagtgttgtgattagaggcatgagccaatgggcctagcctcacttacatcttgacttttttcctcttgactcagctctctacctggggcaccatattggggcattctaaatatcaggccctaggtagtggctcctagaaggccatgttcactgtagcttttttttttttaagcagttctagaagaaaagagccaaaggtgcctcttccccagcagaggcaacagtatgcattgcataccaactgagtcacctgctcatttctgcaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacgtgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaatttttttattaatcagttttataattgacaaataaaaattgtgtatattgtatttattgcgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagactgatcaataaaacctactgtaaacttaccaagatcgtgtggtaccaaaacacactccacaggattacgagattgggagctctagggaagcccgataaaacccaattttaaaatagcacaaaaaataactaactattgggtactaagcttagtatatggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctcattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcctaccatgtgcgaggtgccaagctccgtgctcagaacacagctgtgaaccaggtggacatggtgcccttcctagaaacaaaatctaggctgcaagaatggtggctttaactcacttcaagaaacgcattcaccaagcaccttctctgtgccagcttttgcaggggatgaggtgatgtcacagatatatcagacacagcactgctctgaaatgctcatggaataatagaggagacaggctagaaaatgaggtccattatttgtgttttaaaattaggccaggcgcactgttcacaatagcaaagacttggaaccaacccaatacccatcaatgacagactggataaagaaaatgtggcacatatacaccacggaatactatgtagccataaaaaaggattagttcatgtcctttgcagggacatggatgaagctggaaactatcattctcagcaaactatcacaaggacagaaaactagacattgcatattttcactcataattgggaattgaacaataagaacacatggacacagggaggggaacatcacatactggggcctgtcagggggtggggggctaggggagggatagcattatgagaaatacctaatgtagatgatgggttgatgggtgcagcaaaccaccatggcacgtgtacacctatgttacaaacctgcacattctgcacatgtaccccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaacccaggaggcggaggttgtgatgagttgagatgacaccattgcactccagcctgggcaacaaaagcaaaactctgcctcaaaaaaaaaattaaattaaaaaaactaataaaataaaataaaataaaataaaataaataaataataaaataaaatcaggccagctgcagtggcacactcacgtctttaatccctttgcactgtaacccctaagtactttggtaagccaaggcaggaggaccacatgaggtcagaagttcaagaccagcctcggcaacatagaagtttaatttaaaaaaaaattaaatttaaaaatagccaggtacagtggtgcacacctgtagccccagctactcagggctgacgcaggaggatcacttgagcccaggagtttgaggctgcagtgactgattgtcatgccagtgcactccaacctgggtgacacagcgagatcctgtctctaagtaataatgatgatgataaattaaaaaataataatttttattatgttgttgttactaacaaaatttattgaccccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgactgggctgtgactcaagccaagagctgtttgtctccaagactcttaaagactcttttttaaaaccagcaagctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcagtcatttaatgacaaagggtaactggacaacctaccaccagcaatttatttttagaccaagttaagtcatacttctatgcatgacctcactcccatgactctcctgccctgcccccagttactgtcctcagctctatgatgcaaatattctgcagatgtgtctctgccctgcaagattccctagacagctttaccttgactacagatatgtcaatgtccgccaccatagaaaggtctttatgacctttctgaactgaactgaactgatgctagcttgttccatcaagaccccttctttcactgtgcaaactgtcccccaagctcctgtgctccaatcagacaatcagaactttccattcatttcagcaaagttctattgagcttccactctgggttgggtagcaggctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggtcatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacacctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgagcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttgagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttcttttatagtaacaaaaagaaaatgttgaccacctgtattagtccattttcacactgctataaagagctgcctcagactgggtgatttattaaaaaaaagagatttaattggcccacagttctgcatggctggggaggtctcagggaatttacaatcatggcagaaggggaaacaggcatgtcttacatggcggcaggcaagagaggagagcaggggaaacagccacttataaaaccatcggctttcttgaaaactcactcactatcacaagaacagcatggaggaaagagcccccatgatccagtcacctcccaccaggtccctcccttgacatgtggagattacagttagagatgagatttgggtggggacacagagtcaaaccttatcaccaccctatttacaattgggactccacccctctcaacatgtcctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattcaataaatagtctgaatgactgaatggccaaacctggaggtatctcttcccaacccctcttcctcttatttttttaagcaaaaaacaataggctattttttcatgccaagaaaactgagcctccgtgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcctaagcacatgggacacaaaccttgcattaaatcaaagacttaatccaagttaagccaccctggatgaggagctagagctggagacatgtaattaacaccagccagtcagcaccaactgcttcagatgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacttgtgctttttcattcaatgttccctcaccaatcatctagaacagtatgtagcatatatcaggcactcagtacctaactgctgagttaatttgttggctagttatctgattgattgattgactgattgattgggtggttaattaaatggttaattaatttacctcctgaggctgggcccccatatggccacctagctaagaaacaccatcaaacctggggctgggtattttggttatgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcacctaccctccagtgaactagaacttttgtcagctcctcaaagtcaccaggttcttgccacatatgacgtctcttcctagaacagtcctctccatcatgccatagtcttcaactctggccagcacctgctccccaggtgtcccctgtctgcactcaccacactcttcttgcagtgaatcaccagactgtgggttccacgaagcaagagcccttgccttcttcttccccatggtatcccagtgtctagggcattgccagactcatgcttgaatatttgctaatttggataggagttatcatcttatttcacagatggaagttatgaactttttacacacctaatgtacaggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcgctcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacttaatggctatgtgaccttaaacaagttatctcagctctctacatctttttctcatttataaaataacgatcatggtaaatttataattcattcaacaccgttctcaaggctaggaatacggcagtaaacaatagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcccttgaacccgggaggcagaggttgcagtgagctgagatcgcgccattgcacttcagcctgggcaacaagagcaaaactctgtctcaaaaaaaaaagaagaaggcggccagtggtgcctctggcatccccaaaagcaagcctccaataccacgaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccagtgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggatggtgctactgctatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctggtggagggtatgctggtgtgacctgttactatttagtcaaaggaagattcacagacgcaaggaccagcagttctataagaaagtcttacaaagctccttagaaagacacatacggaaataatcattgcaaggttatttgtggaaggtggaggtaacgaggttgtctatcattggggaactaggcagataaaagtggatgagcaaataccatggggtattagaagtgaccttttttttttaatttttctttttcttctttttttttttttttgagacggcgtttcactccagcccaggctggagtgcagtggcatgatttcagctcactgcaacctccatctcctgggttcaagtgattctcctgcttcagcctgctgaatagctggaattacagttgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatagaccttacagctttaatgagagtgaggagggggagttaaaaaaaaaaaaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcttcctttcatgaagttcaaaaccaggcaaaactaatcaacagtgttagaggtcattacactagtttcctttggaaaggatagactttttttttttttttttttttttgagacggagtctcgctctgtcgcccaggctggagtgcaatggcgtgatctcggctcactgcaagctccgccttccaggttcacaccattctcctgccacagcctcccgagtagctgggactacaggcgcccgccaccacgcccggctggaaaggatagactttaaggattgacggggagactcctgcagtgtgagaaatattctatatgttcatctaggtggtgattacacaagatctatacgtatctaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggcggttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcaggaagctgaggcaggagaattgcttgaactttggaggtggaggttgcagtgagccaagatggtgccactgagccgaatccatcaaaagaaaagaaaaggagaaacaaaagaaaagaaaaggaagggaagggaagggaaagaaaaggaaaaggaaaaggaaagagagggagggaggaaggaaggaaggaaggaaggaaggaaaacctatacacagatacacaaatttatagacgctctattcatagttagcaaaacctggagaaaatctaaatagcctccaaagaggaagtggataaacaaacatccacaccatggaatactattcggcaattaaacaacaaacaaactcctgatacataataaccagaatgaatctcacaggcattatcctgagtgaaataagtcagcctcaaaaggttattatcttagtccattcaggttgctatataacaaaataccgtaaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcataggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcgactttactatatgtacttaaagtataaaataaatgagatattgattcagagtcatattccacaattaataactatattaggaataaacaaatacgcgcacacaatatatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcagcaacacctcttcagtgtttctgcctagagaagcccacgtttaggctcaaagtttgggtgttttattgagagctggtcacataagcacaaaaactagtaacaactattgaaattccaggctcctggaaaggaagcaggtattctgggcgcgaagcaggtattctgggcgctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagatgaaagattctcaccctactgcaatgactctcccagcccactgccaccaaagcttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccacagaaactctctgatattaattgatctgctcctagttttcagttattctattttttaaaacatgcgacagtgttaaccaggcaggctcactagcatgatggatggatgagtgagtgggtgggtaggttgatggatgaatggatggacagatgaacaaatggacggatggatggatggatggatggatggatggaaaaatagatggatggatgtatagatggagatagatatagacagaactagatacagacaaatagagacatcgttaaagagagagagagaggtaattatttatttttgcaacaagtatttattatctactttaggtcaggcactgctccagcttataactgtttgttataacagtaacaaaaacaaacaaacatccactaccttcccggagcttagagagagactataaaaaataaaaataatatatagaattatagatggtgttaagtgctatggagagagcaacatcaagtaaagcgtcttgggaccggctgggaagagttccagttcttaaagaatagggtcaggaaaggactcaccagaaaagtgacttttgaatgaagacctaaaagagatgagagtgttcgggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccacctcttatgttataataatgtggtaacacaaaaagatgggatggcatgtcacatattgactcggaagtaggcaaaaacgtgagaccaacttgggcttagatacacatacctaggaatatactaggtgaagttaaagacagcaggagattgatattctacataaatatggaaatgcactttatgagttcttgagattctctggggatttttcataggtctcacccatcactggtcatgtaaatatgtcatttttagcaaaatcacattctcttcacttctatctgttctatattgctgcaaggactgctttttgaactagggtatgacaatgatctgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagactacaccacaacaggccagaaacgtctaccttatccctcttgaaatgctaccctgagattgacatatggggagtctgggctagactcctcgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagaagacagatgaagcaattagtagtggaaactatccattcattaaacaagtacttatggagctcctactctatgcacacacagcctagtggctcacaataagcaacctttacagccactgcttgacgaaatatctccagacaaaactattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagactattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggttccatttgtgcattctcagacttgtgggaagatacttcaccagccccagccttagaaatgagagtaacagagctgtacaatctctgaggtgttatttattcttaaggatacacttactggcagggaggaaatgctctaagccatttacatacattaccgacatcttctcttttaaccctccaggcatcaggcatctcgagggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtatatccaactgacagatgagtttagaagctatctagtccagacaagcttgaactcagctagtccagcctttcatgcacctcacctatttagtgacagggaagtcattacttctccaagcaacttacattactttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggagtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctctaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaacctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccgttgtcaatctttacattagggtagatttttgaaacttcaggtccctacaatctagattctgatttaattagtctagggtgggaccctggcctttagtatttttttaaagctgcagccctcagtggtgactccaacgtgtaggcagaattggaaaccactctaatttgtatttaatttttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtatgagaaaaagagacagagacaagcagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagacatacagacacacatgagtgtgggcaatcattgttttatagaaatgggatcatattctaccaaccgttcccatgtattcaacaattccttgttgcaagccctccaagttgatttctcaaagaactaaaaatggaactttcactggacccagcaatcccatcgttgatatgtacccaaaggaaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaaaaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctttagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaccttgtcttaaccacctttgtattccctgcagcgccttatacaaggcaggtgcttgatacaggttgaatgaagattatgtttaccaggttccaggtaaatggaaggaaattaaaagacagcccagctggaaacagtgggcaggcattacaggcagggcccgctttctaacagctatcataaaactggctgcttgctggagctgtgaatttcccatcgctggttagagaaattctttaaaagggagattcttttaaaaatggttgtcctagatgatgtctaagctcatctaattttcactaggttactacaatggagaatggttgatgagtaagcaaagacagcagaaacccactacacagtgaaataggaacagatgtgtgttactgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttgtagagataggggcctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttagcttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattacctatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcaccttctgttaatgcccttatacaatcccctcaccatgagtgtgccatgtttctaaatccaaaagtgatgagtgtcacttccatgattgggatagaagagattgacttccatcttgccaccagactctctagcttgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcgcatccatattcctggcccacaactataagataataaatgtgggtcagtcaagctgcttaagtcatggggtcacctggtatgtagcaatagataactaataccagaccccaacataagacgatgtgtaatatttctataattagaaaatattccatcctagatatctcctcctgaaagccattcctgagctcccagaccagggcatttttgtcacctctgtcatggtcttcatcatcctgaatttaataattaatataccctgcctccccatgtttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctccagatgccaaatcaagggtaagggaggccttcaatattcagcaaaatctctactccatgcatcccccacatcattttctaagcagtttcttcctttccatcaccagggtgcttatcaattgtacattgacacttcctcccatctgttcaattcatctgttggatggtcactctctgccacttcagagcaatggggagttcactctgcctttcatacccctctgggaagcccaggaaaattatctctgattaatatcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaataggttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgtagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaagaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattctaggccacctccaaaaagtaatcccgaactaagctgtccacctcccatgctaagtcattctttatcttgttcctttattgtattttttccataacacatcaccattttaaattaacttagttattgcctgcctccccatgaatatataagcttcatgaaagcaaagggtgttcctgacttactcactattgtgaaaccaacatgctagtacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcgtgcattctccatcattcctagacactgtgtgggaagacaggagattataccttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagacactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatgggatcagtgactttataagagatcccagagagatctttgtccctcctatcaggtcagattatagtgaaaagtcagccatgtaagaaccaggaagcaggtcctcagcagacactgaatctgtagacaccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagtcataatgttctctatctacatgacactttccatcttcaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacgtctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgaccttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccgttctgatttcaaattctccatcacttccctgctgtgaagcctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactacttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttatcaaacatcagttatctctatttaaggcattcccccacctccacagaaagaatgaatcattttaagcagtagtttaagcttttactctatccaaacaaaattggcaaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactgggcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaagcgataattactttggctatggaactccaggctattatctggggtgacattttccctcaggttggaatccagatatgtgagacaattaacatttcataaaaataacttttgaagcaatgtttttccacctttctgtatctcagttgtctcttctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcactttcttccaggctgccccctttgagcatcgcttgtaaagactcccactccaaagtggacccttgctgtggtttccatagctctcaggacttccctttgcattgtgtaactcactttggatcactcgtaagatggctgccaccccaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggaaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggttacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttgggtacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaatgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttcttttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgacggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaatggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggatggaggcttggtgggattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgagcctggacatttcccatgtcctacaagcctcctcctgcctttggtagaggtgagtgtaaataaacaaaatgtttcctgcactcaaatgccctcctctattttatttgttatgggagcaaacttccatctccaggacagcagagcgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaggacggtctttttttttttttttttttttttttgagacggagtctcgctctgtccctcaggctggagtgcagtggcgcaaactcggctcactgcaagctccgcctcctgggttcacgccattctcctgtctcagcctcccgagtagctgggactacaggcgcacaccaccacgcccggctaatttttgttgtcttttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggatggcaccaagccattcatgagggatctgcctccatgaccccaacccctcccatgagtctgccacatccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaagtggcttgcataagatctgtctgactccaagttctacagcctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcgtctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaagaaggagtatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtcctggacatatctgtaacaataaatctttgttccactcatcgccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggcagggagactaaaaaaatgtaaatggatttaccaaaataatctcgaggtaagacctttgaggcttgataccacagaagtgccatattgtttttaagtttcttttttttttcttttgtaagtttatttttctcctcggagggcactgaaagttttgttgtgagaagcaataaagttctgttttccaaaagagaataaaagcatgattgtatttttaaaaatcaatcttaataatttccagccattactttatgagcttaatgcaattcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagactaagtgtccttatcctgactccatgctctttccagtgagttcttcaccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatatgtccttttctggctgggagcagtgcctcatgcccgtaatcctagcactttgggaggccaaggcaggaggatcacttgagcccaggagttcgagactggcctgggcagcacagcgaggtctcaactctatcattttttaaaaaatagaatatgtcctttcccccttgcctgcctggataaaaccttcttctttatctcttgctgcttcccacttcgcattttctgctctgttaaacatcaaaccgcttctgttgcccagaactatgtctcaggttccatgcagctgtgcctctgcaatgctgtgcctttttcccaaatgctgttcctctacaatccacttagcaaactcctgttcatccatcaaaaccctgatgaaacataaccttttaaaagaagtcgtcttcatccctctcccacttctagacccaatggaattcacgcgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctatcgcagagcaatcaaccagaccatgtttccctaataccgattacaaagctggcacagaggcaagacggagcagcagtggggatttatgctctctggacatctgttgggcgtctcttctgataaatcctcgccttgccctgctgacgatctcatctttcagaagacagaggaagcgacagagaaaacggttacttgccactaaatcctggcaacgaggaaacactggttaatgagaaaagtggaatccttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagagagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacacacatatacatacacacacactgaaatccaaatcacggtcatgtgacacgatcaagctatttcttccagccttggcagctttctaggacaggcagccaccctcctttgtgtgctggctgagttctccactttgcttccacctcatgaggctccatctcaacagatgcttcagagcttgcctcattcagggggaaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttctgaaagatgagaaagaaagcttccatatgcagcaatgaacactggccaagcccggcctctgtgtactaccaggggagagaggagaaacatgaaaacaaaaattaatatctagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcttctttctcttcttatagggacactaatcccattgatgagggctccacccttgtgatttaattaccacccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgcgatctcctgacctcgtgatccgcccgccttggcctcccaaagtgctggaattacaggcgtgagccaccatgcccggccgaccctttttgttcttatttgatcattccaggaatgctcataccttagtgcctaggtactttggggttctctcttcctagaacacttctcagaaaatgagagaatgtcttgttcaagtgctattatatttactcattgaaaccttccataattacctacttgaaattatggcatccactccactcctcacactctctattctctttccttcctgtattttcacattggcaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttgtttttgagacggactcttcctctgtcgcccaggctggagtgcagtggtacaatctcggctcattgcaagctccgcctcccaggttcagccattctcctgcctcagcctcctgagtagctgcgattacaggtgcccgccaccactcctggctaattttttgtatttttagtagagatggggtttcactgtgttagccaggatggtctcgatctcctgacatcatgatctgcctgcctcggtctcccaaagtgctgggattacaggtttgagccaccgtgccgggcctagggcatgtcttatttctatatactccttctacaccttttattctggcattgcaaattcctagcaaaacatcctgaagggttcatgctgaaagggcaacctactcttcccatactatcttactgcaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgttttcagggaaatgaggttgagatcaaaaccaggacccagcgcatgtgattctgtatcataaagaatatggaagtacatgtatggagctctagtgaaatttgcttggactcagttaagatgcaatggtttgcaagtagttataacacctgaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaactggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacagggccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcactgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacacaggagaaaactatcatctgcaatccaggaagagcccctccccaagaaccgaatcagcaggcaccatgatctcagacttcccagtctctagaactgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagaaatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctcacaaacaaacacacacacacacacacacacacacacacacacacacacacacacaatgggtttgggattcagaaaggcacagttcctaaactggctctgtcatttatcatctatgtgacctgaaggcaattcacttaatctctatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccatgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagctttgggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttcaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgtttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaacgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcggatcctattccattccctttatctccctgtttccattaaaaataaaagcctcagagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacgacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggtgggtgaatcacctgaggtcaggagtttgagaccagcctgaccaacatgatgaaaccctgtctctactaaatttaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaacaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcactcagcccactttcctgactcatgcccatgcaaaccccagctaggcaacaaatacttatattttttgattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaaaaccccgcaaaaccaacaaaataaaacaaagcacctcttcctttgtttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcctgttgccccaaggtctcagaagaggggatgtgctacaatggggagttatgggttttgcaatcagaccctgacacttcactggctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggagggttcagaaacagcagggaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcctcctgaggtcggctcgatcccaacttcatgtctgtcccatccagccctcttcaattccactctcctctctccagttatgacccctggatgcctgaagaagccttctaactgtgctctccactgtccagctctgctccctccaatctgccctgcatgagcccctgagggatctcaccctttcagcaggtccacctacaagtataacccctctaggtgacataccttccttcgggaagcttctcccaacaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagatgaacaacgacaagtattgatgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgacgtgctgatccacactgcaacacagatgggtctttaaaagctatgtaagtgaaagaagccagtcacaaagaaccatatgttatttcaatccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattccaatcacttcctcattgttcaatatggcttcatatatttcttcataaataaatatactgatttaatacgtgtttattcgcttattgtctaccacaacagtaaaggtaatttcaatgagagcagagcctatggcgcattcacttctatattcccagtgctttgagcatggcacaaaaggctactaaataagtaagtgccagtgtgtgaatatatgagtacctgtaagaatcagcaaaaataaaatactgtttccagggccccagccccagagattcagacgcaattgatctgagggagagcctgacaaaggtctggctcaagacttcttgagtgataccattgtacaaaccaagacgaagagccctgatccacagcagttgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccggaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacatgctgaaggtagggatctacagagtcacattcatgcaaggtctgtggcacaagacctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacacagtatttggtaaatactagtggaatgaattatccgtaccttgcatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttttttttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccagctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatcagatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcacgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagacgaagccagagatatagatgagaggctatccaaggagccactaagtgaggggcttggagccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcgcctcttcaggtccctgccatggggaagagagataacgtttgtttgtttgtttgtttgttttttagatgcagtttcattctttttgcccaggctggagtgcaatggcccgatcttggctcactgcaacctctgcctcctaggttcaagtgattctcctgcctcagcctcccaagtagctgggattacaggtgcccgccaccacgcccagctaattttgtatttttagtagagacggggtttcactatgttggccaggctggtcttgaactcctgacctcagatgatctgcctgcctcagcctcccaaaatgctggaattacaagcatgagccaccgcatctggccagaagagaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttgtattccctgtaagggcagaaattcagctcatgtaaacctcacagtaatccttatccccatctaacagagatggaaatggagactcaaagaggtaaagaaactcacccaaagaaccacagctaaaacatttagcagagtagggatttgaacccaggcctgtccacctgcacatcccttgcttgtttgccttattgagctgtctcgtcaatttcatcttcgccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaaacctcaactgtagaatctcttgattatcaccaagtatatgggcttccaagcctacctaccttcaaagtcaaggtcatcacaatgggataatccctcaggcaaaaagaaagatgagttttaggggtcttctggtttccatagaaaaggcgctccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaattcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctacatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaagtttcctttggtggagagagaagaagaagggtaataggaatgaaaatgggacttctctaaggctgagaagaggggagaaccaagaaagaggagtgtgggagtgctttgttctgccaggtgcagtcaataggtgccttgtctgtaaagaatttaaaaaacagtaatacaatcaactattaaatgcaatttggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttggaacaatgttaatgttctgtaaagacaaatataaaacaaaatttgaaaacaaaaacagaaagagccacaatattgggcatgaataacccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggaatgaaccaccaggcctggcctcaagttcaggtttgagcagctctcaccaaaatcccactgcagtaaaattcacagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctcttcatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctatcaaaaccgggtcacacctcccatctctctccattctctatacctactttatctccttaatgctcactatctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagactatcttggctaacacggtgaaaccccatctctactaaaaaaatacaaaaaaattagccgggcatgggggcgggcgcctgtagtcccagctactcgggaggctgaggcaggagaatggtgtgaaccctggaggcggagcatgcagtgagccgagatcccgccactgcacaccagtctgggtgacagagcgagacttcgtctcaacaacaaatatatatatatatacatacattaggtgcaaaggccctggggtgcaaacgtccatgcatgctaaaggggagaaggaaggccagtgtggccagtgtggctagagatgagctaagggaggagaggagggcagggcctttgtagactacagcaagtggttttataagggtcttattctgaatgcaacaggtagctgctggatagtcataagccgtggggtccgggtggtggggaggttgacatcctctgattatatttattttaaagatcattctggtttctatatgaagaatagactgaataaggcaagaggtaaagcaggggaccgattataaaggctaccagaatagcccaagggagatgggatggtggcttggattacgggggtagtgctgaagagaggaggcttgtgggtgtttcttggtaatttgtggataaactagatgaggggcatgagagaaagaaaaatgtcaaggatgactccaagtttaaggagctgagcaagggagtggatgatagtggcatttactgagatgggggttctgcagaaaatacaccttgaaaggggaataaaaagttagttatgttttgtcccagaatcacagcaataataaattagtcttaatgcattaagttttggggtggtttaataggcagaaatcgatcactgaaacattctgtctaataagtactgtttccttgatttcaggatgcttttgatggagtaatgagcgtcaattaaatgcacacatcaaatgaaaaacacatcacgattttagaaacctacttaatatcttctttagagaaacatctattaaagtccttagcccactttttaatcagattgttagagttttttttttgctattgagttgtagaaattccttatatattttagaaattaactccttattatatagatggtctacaaataatttttcccattttgtgggttgtcttttaactcgattgtttcatttgctgtgcagacactttttcgttttacatagttctcatcatttatttttgttgttgttgtctgtgcttttggtgtcatattcacgaaatcattggcaagaccaacatcatgaagtgtttcccctatgttttcttctaggagttttacagtttcgggttttacttgtaagtctttagtccttttttagttgattttcatgtatggtgttagataaggatcctatttcattcttttgcatgtggttatccagttttcccagcatcacttattaaagagacaatcattcccctattacatattcttggcaccattgttgaagattatttgatcacatatgtgtagatttacttctggacttgctattgtattcctttggcctatatgtctgtctttatgccagtaccatattttattttataccagttttaattactgtggccttgtaatatattttgaaatcaggaagtgtgatgcttccaacactgttcttctttctcaaggttgatttggctatttgtggccttttgtggttctatacaaattttagactcattttttctatttctgtgaaaaatgcctttgggattttaatagggattgcattgaatctgcatattgctttgcatagtatggacacttgaacaatatgaagtcttccaatccatgaatttggaatgtctttccatttgtttataccttctttcatttcttttttttttttttcttttgagacaaaggctcgctctgtcaccaggctggaatacagtggtgtgatcttggctcactgcaacctccgcctcccagattcaagcgattcctctgcctcagcctcccgagtagctaggactacatgcacgcaccatgatgcctggctaattttttttattttagtacagatgggttttcaccatgttagccagaatggtctcaaactcctgacctcatgatccacccacctcagcctcccaaagtgctgggattacaggcatgagccaccatgccgggccaccttctttcgtttctttcaaggttttataatttttagtatacaagtctttcacctccttagttaagccaacaagtttatgaaaaaatgtccaataccacaaataatcagtatcactaattgcaaatcaaaaccacaatgagaaatcacctcacacctgtcagattggctagtgtcaaaaagacaaaagacaacaaatgttggtgaagatgtagaaaaattgaaacctttgcacactattattggcaatgcaaaatggtacaaccactaagaaaaacagtacggaggtttctcaaaaagttgaaaatagaactagcatatgatccagcaatcctacttctggatttatacccataaaaattaaaatcagaatgtggaagaaatattagcactaacatgttcattgcagcactgttcacaacagccaaaatggggaaaaaacctaaatgacagattaatgggtaaagaaaatgtggtatatacacgcaatggaatattattcagccttcaaaaagaagaaaatttgggatgggcacagtggctcacgcctgtaatcccagcactttgggaggccaaggcgggtggatcacctgaggtcaggagttcaagaccagcctgaccaacatggagaaatcccatctctactaaaaatacaaaattagccaggcatggtggcgcatgcctgtaatcccagctactcgggaggctgaggcaggagaattgcttgaacgcaggaggcggaggttgcggtgagcagagatcgcaccgttgccctacagcctgggcaacaagagtgaaactccatcagaacaagaggaagaaggagaaggaggaggaggaggaggaggagaagtgggggggaagggagggaggggggaggtgggagggggaggaggagcaggaggagaaaattctgcaagatgtgagaacaagaattaaatcttgaggactttatggtaagttaaatatctgtcaaacaaagacaaatatttcttatttccacttacaggggtcatgtgaaatagtcaaatgcgtagaacaaaagagtgtaatggtggttgccagggctgtggggaggagaaaatgaggagctactcatcaatgggcgtgaagtttccgtcaggcaagatgaatgcgttctagagctctgctgcacattatgtacctagagtcaacaaggtattgtgcacttaaaatttgttaagagggtacgtctcatgttaagtgttatcacaataattttttgaaaaaaaatctgtttactatatgccttgacatgaagaatataggtaccagatgacgtatctatgcactccaagctctgtgtctcacatttatttcaatcacatgtagataacagcaagaatctttagacaactcagattgcatctggcttatcacctggtttgtccctaaatttatcgtttctacagagtgagcagacatgtccctctttctctctctctccctctcagggcatatttcaataacgttctctttttgatgaagtcacacaagacgcagaagcagtcctaaaactcaatttatggaagtcagttgagaccagactttggattgaacctcccaaacctgcctaattaatgacacacattatggcccctgctcccctaactgaatgcagcctccaaaccttgacgtgttttcccaacaataaaatgcagtaaatgaatgagtgtcctgagggaccgtggcaggaataaagggaaagccatgaaagatagatgatgtctcaactaattttatgatttatcgatctccactttgctcattttgcaatgcgggagagctcatttttctgccaggcccacagtggtgtcacccttgctaatagatatgattaccatccccaaaactgtgtttgtgaaaataagaagtgtggcttctctgctgctgctgacctcagcagttttcttttattatgtgctggatccgctaagaagcaaaattgatgtacttatccggggactctgttggacgggcacaagcattttcctcatttttcttccaaacaagttcatctttaagcaagtacagattcatggtttaaattacggcattgacacatcatctgttttcagtgtgtgtattcttacaaggaggatcttttatgtgatcagagagaggaagagaggggatagaggtgtcacccacgtgccaagttgagtttaaagatatacatgttaggacacaatacaggctgctttggatggttcaccaactgcattcagcaaatattgattgggcacaggtattgtgctaagcatgccgggggtattcagtcatttaataaatatttattggcaggccaggcacagtggctcacacctgtaatcccagcactttgggaggccaaggctggcagatcacgtggtcaggagatcaagaccaacctggctaacacggggaaaccccatttctactaaaaatacaaaaagtagccaggcatacaaaaataaaaaaaggtgcacgtgcctatagtcccagctacttgggaggctgaagcaggagaatcacttgaactcaggaggcagaggttgcagtgagccgagatcgcgtcactgggcgacagagcaagactccgtctcaaaaatacatacatacatacacacatacatgcatatttattggtgatttcatatatatagctggaattatagagcaaaataggcaatgtctcttttatcatagaaactatgtcctgattagaaaagatggaaagttcaaaataataattatgaagtgcataaaatagggtgtgttagtcaactatgccacagcagtgctgggtagcatacagccagtaactccacaacagcaagcatgtgtacctcatttatgcaactatggtttgtcctgggtttggctgatctaggctgggcttggctccaggccacatgtttagttcatgtctgttccttgcatctctcactcttctgggaccaacaggttacccagggcatgttaccctcatggccatggaagaactaaagtaggtgagcccaaccactctatcacatttcaaatctctgttcacttctacccactaatatcctgttggccaaaacgagtcatatggccaagcccaaaatcatgtggtagggaagtaaataccatccacaattggagcggggaggccatcaacacttgctgggcaataatccaaactgttatgcagaatgatgtgataaaagggatcagagagaagtgctgtgaggaatggggatgagttcactgggatgatgtcagagaggcaggcgagggccagatcttgctgagctacggaaagaaatggcacatttgatttgtgatttcaaataatccctttcactgctatgggaaaactggattgtaagtggcacgagagcagatgcagggagtcccagcaggtcggacactggttcagtgttctaggtgggtggtgatagaaggtgtgcacttgaatagtggcaatggagatgaaggcaagcgctagactgagaaacagaagcaaatggacagggtaccaaagtggataacatgtggtccctgaccttaaagagctaataacctacttgatgagaaaaagatgtacagacacagccatggtttggagagatatgtttttaaaataaggccatacacaaaatactaaaaaaaaaaaaaaaaatccaaaaaagagctgtgaactttgtctgagagtatctggataatttcagggaggaggtgatatttgaggtggacttccaatgtgtcatgtcaaatagcaccaagctgataagcaagaaccatcttaatcagattgactgggtgccacaaagccacacctatgatggacacacaggaaagtctagcagccaagcagagggaggatgactttccacaaagacaagtatttgtgctgtaagactacatgctttgacccatctgcaaaatgggtgcatctgcaagaaggaggccaccaggcaataggctgggggccaggtaggtacttcttgagtagtgtcacacactattcaaggagatctgtgactcagtatacccaagagaacctccaatttgccgccattctgccaaagggatgctagaggtttgaggaaagcagtctggcaaagataaatcctcagaattgaaagacctaaaagcacagaaccatccgtgtccccaactaactcggtgatttctttgctcttcagtttccacaaaaataaaatattatttatataacatatgcagatatatgcaccaagatacaaggcatgccatagactctcaaatatttgttgaacagataaaggaacatttaacacaacatttttataattgtaaaaactttgagactacccaaaggcctttagtaggccaataattaaataaacactggtatattcatatcttggactattacgtagctatgcaaaattttctcattagaaaaattcattattaatatgtgggaaaaacgtggaaaacacggaaagatgcaagaataaaataaaacacatcccctagagataacctctattaatattttgtagtctctgcttccatcctgtgtggtacttttgtagtgcatgggcattgtgtacctatgtgtttttagctaacataaatgaaattatattaaacatatgaattcaaattctgcttttttccctttaatattgttttatggtgttttgtttgttttgagacagagtcttgctctgtcaccaggctggagtgcagtggtgtgatctcagctcactgcagcccctgcctcatgagttcaagcaattcccctgcctcagcctcccaagtagctagaattacaggcaagtgccaccatgcccggctaattttttcttttagtagagacagggtttcaccatgttggccaagatggtctcgatctcctgacctcaggtgatccacccgactcggcctcccaaagtgctaggatcacaggcatgagccaccgtgcctggcctacagtgtttttctatataaatttttacaaagaggtttagcaatgtaaaaaaattgcattgattttataagaatggaaacatggaatacaaaatcatgtatctggcatgagtttaagtacgtaagtatttcgtatagacagacatgtgtgttttgtatacgtctgtatgaatgaccgtaagaaaatatacccaaggttagtaatgattgtcttggggttgtgggattattatgggctgtcatttcatcacttatatttttctgcatcttctttataacataaaataagcatgtattactactgcaataagtaaaaagagaaatgttttttgaacaggagcaatgaatttgaaagaatccaaggacgagtgtattaaccaactgtgatatctacgactgtggtttcacaaattaggggcatacttgcagcgccaggctcacctcgacctcctagagttatgcctcctcctcaggccaggccttagaggtcatgagacaggctgaggaaagagaggtccaggccagcatccatggaatctgtcccattagctcagagacaacaaaaaggggacagatccagagggtggggggactggcaatgcaggacacaggaaaagctagactaaaagatcccgggcaccgggagatcaaagggccaaagcgagcagcagccagccctcagaccaaagactccccaacacgccccacacagcaggaattcaagaaattccaaagcctaactctgaggatgtgctcaaaccctcacattattgaccatgatggcaagaaaagtcttcagtatcattttcgttatagaagttagcggagaagcaggcagtggaaacccaccatggtgatcagacagggccctttgtttgcatgagcttaattattgacttagaaaacttgagcatcctcctttgccagagaaagaagcacctttttttttttttttgaaatggagtctccctctattgcccaggctggagtacagtggcatgatctctgctcacggcaacctctgcctccggggttcaagcaattctcctgcctcagcctcacaagtagctgagaatgcaaccatgcaccaccacgccgggctaatttttttgtaattttagtacagacaggatttcaccatgttggccaggctggtctcaaactcctgacctcaagtgatctgcctgcctcggcctcccaaagtgctgggattacaggcatgagccaccaagcccgggcagaaagaccaattctttcaccatggcattcaaggcttccctgggtctgtctccatcaaccaacctacctacacacacacacacacacacacacacacacacacacacacaactattgtccatacctgccaagactttgttcatcctgtttcctctgcctggaaggcctttctctcatttccacgtatctaaattctttacaactccaaagtcctcttcttaaaaagcctttggaaaaaactattgagtgaataaagcaagggtctgctccagtcctgtctgagtgaatcagacaggtctgctccagtccaggcccctctccttactggctgtgtgacgttggacacgttcaatcgtccttctgataccaattttctaattagtaaaattagcttctaattgaagctgcctccaaggctttctgtaagaattaaaggagaaaattatttcagatatctatttaaaagtagccgaatttatgtcaataaatggcaacaaatataaattttatatcctctttcctagtatcagttccccacttcattttctaggtggcattttgcctacgggttcaccatcttctgtccaagtttacttttatgcctcctggagtcaaaggcaactgccgcctctgagtttagacacaattgggttgcatcttagctctggtaccttctagctgtgtgtttttgaacaaatcatcacacctctcagagcctcagcttccccatgtgaaaaatgggtttaatgtttcacgttggggagttgagtgagtcaatgtacattaagctcttggaacggggcctggcacacagccctagaagggttcgttgttactgcctcacagggttatggtaaagatggggtgggtttctgtttgtctgcaaagcccttatccaaagtcccaacacgtagcaagccctctgtaaatatcagtcgtataatcaggaatttagtaaacaagtccaatgcccctcactccacccccgcagcaatgtaatagatgtcagtcaatcccttttttgggtcttttcagaacaaaaacccctgttctctcctccagtggggtctccctgggctaactgaaccatcctcctggtcttaaacaggaggattcctggagccaagtgggatccttctcctgcaccacgagggcccaggggccaggtaacatactgtctggctaatctggagccaagcagaaactggcacagaggacatccacaggcttactgcatttccttcccctgtaaaagaaccctacggtccagcccagcaagcacctctctttgaccagctaataaggttataaaaaaacttatgtatctgactttaataatggtattaaacccagtaatctgactttaatagtggtatgccaaggcaaacatggtcctagcagggaccaggagcgagggcaggtgagggtacacatctgaggctgagcgacacctcctatatgaagttgattcatgttggagcaaatccgggcagggaccagctgattcaggcagttaagttattgctctgccagtttaatatttcgccatctgctaactgaaggctctactgcctgctgggtcctataaagacttttatttattatactacacatggcaacatctgccaccaggatgaggctctactcggcgccctaattaaacaaacacacacttcagtgacagcagagggccgggtctcgctgtgagccgaactgttgctgggagttaaaaacttggagtgtcccatcctgaagagcctttgctgagaaaaggtagcatgagtcattcacctcctggtggccactaaagatttacaggtgatttaaagcaggctggaaaaaaaaaattaaaaggctgggtgtttatctcccctaacctgcctctcactcccaaacagaacttgagtttcagggcttggtttggccaacggtcagaattcctgcttcacactgtcacatgagcccctgcccttcaatctccgtgcacactctcagaaacaagccctgcagatgaagaaaatgaatgtcaaagtttccattcaatttttcattcatgcatgcattaaaaaaatatggagtcattctactataaagacacacgcccacgtaagtttattgcggcactggtcacaacagtaaagacttggaaccaacccaaatgcccatcagtgatagactggataaagaaatgtgacacatatacactatggaatactatgcagctataaaaatggaggaattcatgtcctttgcagggacatggatgaagctggaaaccatcattctcaacaaactaacacaagaacagaagaccaaataccacatgttctcactcacaagtgggaactgaacaatgagaacacatggacacagggaggggaacatcacacaccagggcctgttggtggggtggggggctggggagggagagcattaggagaaatacttactgtagttgataggtgcagcaaaccaccatggcacgtatatacctacgtaacaaacctgcacgttctgcacacgtaccccagaacttaaagtataattaataaatgaataaagaaggagtatgtgctacataacccgtactctagcaggtgagctggtaaataagatagacatttgtgtcttcataaaagccccatttgactaagtcaagaggacacataaatggataagataattgcagatcgtgctgagtgttaggcagcaaataaagagggcgatatatatattagatactgggctggcatacaggtatattagtttcttattgttgctggaacaagttaccacaaatttagtggcttaaaacaatacaaacgtattatcttacagttctgtacttcagaagtccaacatgggctaaaattactgagctaaaatcaaggcactgggcaaagatcaagatgtcagcagggctgctccttctggaagctctagagaacatccattttcttgctttttccagcttctaaaggctgcctgctttctttggcttgtggccccttcctccatcttcaagggcagtaacatacctgtttccgtcatcacactcctacctttgactcttcgattctgcctctctcttccacttttaaagatctttatgattcctttgggtccaaccagatattccaggaatagctccctaaggtcagctgattagtaaacttaatttcgcctgctgccttaattgccctttgccatgtcacttaacatactcttgggttccagggatgaggatgaatttcaaagttcccattcaatttttcattcatatatgcattcaataaatattgagtatgtgctacataatccatactgtagcaggtgagctggtaaataagacagatgtttctgtcttcataaaaaccacatctttgcggggtgtcattattctgctgaacacagtggacaagaaactactttagatagcgtggtcctcaggagggcttctctgaaatgtgatcatgagaaagggttgcaagcagaaggaaaaggaagtatgaagatccagaggcaggagagaatttagaatggctttggtactgaagggaaactagtcatgggcttaggagtcagagagtcatgggcaagggaaaagtggccccagatgaagctgaaggggtgaaaaagggaggaatcagatcacctagagtcttgtgtgccttgcagaggcagcttggtgcaatgatcaaaagcccagacattggaagggaacttactttcacttaacacctaatttttaccagaccctgtgccaggacctttaaatagattatctcatttagttcctggaacaagtacatgaaatatgcattgcaattcccattttgcagatgagaaagtagtgacttaaacaactaaattataaagacacactgatgtgaattctgaaatatctggctcagagcccttgctttctccaccactcaaggctcctgtccaaatgattttgccttccgtgcatgtgtgattatgcagccaggatcctctatcttcttttttctcatttaacttgatagacagactgcagaacctcaaaatcacctgcagtggagtgtcccactgaatttgtgttttgcttaccgctttatcaagaggtacatgaaattcctcttgcctgctctaaagaggttggatcatcagtgagactgaacctataagctctccagtcccactagggaggatgcatgttatttaggacaccagctgagttgctggtacaagagatccaaaaacacagtgactcaggccaagtaggaatctacttctctttcacagattggtccagaggtacatagtctagggctgccatagtttctttgccccttgcaatcagtcatctagggatctggttccttgcattttaatgttcttctttcctctgaagtattgtcctcatccacatggttgaagtagacttgccagaactccgtcaaattccaacgtgtagaaagaggaaatagagaatgaaaggcaagtattttcctttccagtgctgtgacttgaagctgcacgcatccgttctgctcacaccctggaggcagtaatttagttgcgtgtccacacacagttgcaagagaagctaagaaaggtagtctctacctagatggtcacatacagagtgaaagcttgagaagttctactgctaacaaaatgaaagagaaaataaatactggagaaaaattagcactctgccacaaaggatgactgcccttttggtttatctaaagtccaggcattctttgcctgctggatatggtttgtagaatttttagaacgaataaatctctattgttcagaaaagagaaccaaattaatttcttttctctctcaggggctgaaagtaaaaatggcctgatcctgggtaggtctcattcacctgctgtcattggaaaaggcattggagttgtggggaccacggtgagtggataaacaaacctcatccagaacaggacctctaagaggggttaccgtgagagttaccagcctgcactacattgtagcccagcagcactggctccgtgttcaacagtgccatcttctctcagtaggaaacccaaacaggctgacaaataccagcgcttttccctaattgggagtacaagttgtgaggactcctaattatacaagaaccctggaactggagcagaaagtctcaataaggtaattcaggacttctggccaacctggaagctggtaactcaagtactcttgattaaatttggggaaaaataatttaaattcatgatagtacttgctcttgaggtattagtagaaatgctatttctgtcaataaacaaaagagtttttttaaaaataaaaaaaatcccctgaatatatcctcaaacgtgatgccaaagcaaagattgataaaatgccaaagatctggctaaaaaagatgcaaagaattcatggaagagccaatgtgacccactaaaaccactctaagtgcaatttttgaataaaatcccacttaaatgattgtttacctgaggtcaacggaggaccagggcagtcccaatgagtaagggacttaacatgggccacgggggtacatattgatgacaggaatcgcctgacaatcactaagctgatggcctgttctccatatgttcctcatctctccacctaaatttaatgtatccaactttttggaatccttcctcttagtcttgcattctgtacgtatatgaggaaggtaaggaactaggggttgcctaggagggatggagaaggataaatgcaaaaataacactgaagcgatggccttgcagccagatgacattttaggtagatccgcacaaatgcctacaaatgaaactccagggcctcaaatgcttcatctgtgaaatgggatgattacttgaatcaccgatataaattatgtgttctaggaacaaacggtggctcacgcctgtaatcccagcactttgggaggccaaggcagacggatcacctgaggtcaggggtttgagaccagcctggccaacatagtgaaaccccatctctactgaaaatacaaaaaaagttagccaggtgtggtggcaggcacctgtaatcccagctacttgggagggaggttgaggcaggagaatcacttgaacctgggaggcggaggttgcagtgacgtgagatcacaccactgcactccagcctgggtgacagagtgagactctgtctcaaaaaacaaacaaataaacaggagcaaaagcctaagctcagctttgtggctcaagaatagtgtccctgaggaggcagcatttgaggagggtgtagaaggaggggagggattttgatgggcagagacggtgtagaagtgtaggagaattgtgggaagtagattgtgtggaaggcctcccccagcttttatctcctcaacagtgaagtgggttacaagattattttgcaagttagaaataatgtttgtggaacacacaggacagtgtgtgacattaaaaaaataaatcaagtgattatgattaaattaacaactagtcactgactgtgacaaggttggggaatctgagactcctatgtaaggctagttattttgaaggaagacaatgctggtggtgtcttaggctcctaatggaggcaaatgaaaattctctctgtgtgaaagcattttctacttgggtcataagaatttccatagattaagatcaagcctctgtaagcttataatcaaaggccaccaaactcattaggaaataagccaccatgagggagaatcagcagaattaataaacaacaaatttttactcccacaaacttcagatactggaaccattgaaataatcagatacataatataaaatcattctgattaaaatatttaaatgaataaaagatggaattagaaaaatgggaaaataatcaacgtttataaaaaaattatgaggtatagttgaaaaatgatcaaataaaaattttggaaatcaaatatataactgttgaagtaaaaaactcaattcaactagccgggcctggggacgcaggcctataatcccagctactgaggaggctgaggcacaagaatcgcttgaacccaggaggtggaggttgcagtgagccaggatcatgccactgcactctagcttgggtgacagagtgagaatctgtctcaaaaatatatatataacaaaaaaatgaaaaatataataaaaactcaattcagattaaaaatagcaggaaagagaattagaacttgaagatatgtctaaagaaattatctagggtgcaacaacacaaatagattaggtgattaaaactattaaagagaagttaggagatacagaggacagaaagaaacagactaatgtatgtctaatatattagacatactattgggagagaatagagagactggataagaggcaatattaaaagtgataatagatagaaattttgcaaaggctgggcagggtggctcatgcctgtaatcccagcactttgggaggcagaagtgggtggatcacctgaggtcagaagtttgagaccagcctggccaacatggtgaaaccctgtctctaccaaaaatacaaaaattagcccgccacggtggcacatgcctgtagacccagctactcaggaggctgaggcaggagaatcgcttgaacccaggaggaggaggttgcagtgagccaagactgtgccattgcactccagcctggacgacagagtaagactctgtccgagagagaaaggagaggaggggaggggatggaaggggaggggaaaagaaatgttgtaaaaatggtaaaatacagtcacgtaccacataacattttggtcaacagactgcatacatcagtggctccacaaaattgtaatactgtatttttattggaccttttctatgtttagatatgtttaggcagacaaaggtttaccattgtgttccaactgcctatagtattcagtagagtaacatgctgtacagtcatgtagcctaggagccataggctataccatatagcctaggtgtgtaggaggctacactatctaggtttgtataaggacactatgatatgcacacaatgatgaaatcacctaatgactcatttctcagaacatatcccgattgttaagtgaggcatgatgagatagacagatagatagatcatcatatacactaacacacacataaaatcttcaggtccaagcacagcatatataagcaagatgaatgcaaagaaattcatagctagacatattgcagtgaaaccacagaacatcaaagacagagaagacttaaaagctcacaggggaaaggggcagataaccttcaaaaacactacatttagatcaccacctgagttttcaggcaaagcaatagaagccaaaagactctggaataacatctccaaaattctaaaagaaaacaaccatcattctagaattgcgcttcaggcaaatgtgtcttttaagaatgagtgtgaaatgatgacacttccatataaacaaaaactgagagatttttaccactgataaattcccactaaaagaatactaaaaaaaaaaaaaaaatagcccagaaaaaaaaatttcgagtgtaagaatagttagcaagtaagcttacaaactgagagataaatctaaaacattatctgtgtaaaatattaatagtaacaatctgatttgtgagaatttaagatgagattgaaactactgacaacattgacatttaagtaatggggaagtcattgacattaaagtatcataaagtccttatagtatttggaaggggaagttaagatatttatgggctttcaattttccttgatacacacaataaaatttcaagggagagatgatagaaaagaggttttaaatttttggaattttagaatttttagaatcttaatatttgaatttggaattttagaattccaacaagtaaagggaaaagcagagtttgaaaacaaaacaaaaacaaacaaaaaacctcaatttaaagaaaagaaagaaaagaagcatgaagaaaaatggaataaatcttagaaaccatatagtgtgaacaaagcaagtcttaaaatattatttaaggccaggcacagtgactcgcacctataatcccagcactttgggtggccaaggcaggcagatcacaaggtcaggagttcgagaccagcctgaccaacatggtgaaacctcgtctctactaaaaatacaaaaatcagccaggcatggtggcacatgcctataatcccagctactcaggaggctgaggcaggagaatcacttggacctgggaggtggaggttgcagtgagccaagatcgtgccactgcactccagcctgggcaacagaacaagactctgtctcaaaaaaaaaaaaattatttaaggtatgagaccatctttataaagctcaaaagcaagcaaaactgataaagctttgtggtaaagctaacaaagcaaagaaaggggatgataaacacaaaacaggattgtagatttccacatggggataggatgggggatgcaagaggcacttttcatccagatggatccagtagaactgttcattttagtcaatcagttaggcacttaatgtagtttggatatttgatcctcccaacatcgtgttgaaatctctccccatgttggaggtgggacctattgggaggtgtttggggcaggggagttgattgctcatgaatgacttgctgccattctcaaagaagtgagttctcattttgggctgggtgcagtggatcatgcctgtaatcccagcactttggcaggcagaggcgggaggatcacatgagaccaggagttccagaccagcctggccaacatgaagaacctctgcctccactaaaaatacaaaaattagcagggcgtggtggtaggcgcctatagtcccagctactcaggagactgaggcacaagaatcacttgaacctgcgaggtggagactgcagtgagccaagatcatgccactgccctccagcctgggcaacaaagggatatcctgtctcaaaaaaaaaaaagttctcattcttagtcccaggagaactagttgctgaaaagagcctggcatctcctcctctctctctcgcttcctctctcaccacgtcatctgtgcacacagtccctccacttccccttctgccctaagtggaaacagcttgaggccccaccagaagcagatgcagtgtcaggcttcttgtacagactgcagaaccatacaccaaataaaccgctttttaaaataaagtgcccagtctcaagtattcctttatagcacacaaatggactaagacagcaatgattttatgggtcttcattttgttgatatgtttgataacttacatgttatatatatattatttgtgtgtttcaaatattgcattaaaaatatttaaaaataggccaggcatggtggctcacgcctgtaatcacagtactttgggaggccgaggcaggtagatggcatgaggtcaggagttcaagaccaggctggccaacatggcgaaactccgtctttactaaaaatacaaaaaaaaaaaaaaaaaaaaattagccaggtgtgatggccagtgcccgtaatcccagctcctcaggaggctgaggcaggagaatggcctgaacccaggcagcagaggttgcagtgagccgagatcacgccagggcactccagcctgggcaacagagtgagactctgcctcagaaaaaaattaaaaataaaattaaatgcagaaaacaataggagggtaagtttcccgaggacaagagcaaaaccagagcttttctgtatcccatctactgtacacacagtgggccctcaacaaatatctgcttacattacagccagggaatttgtttactttagtgcattacaaaagaatgagaaaagccgagtcttctcaaaagcaaacgtcaacgcggcagacagaggactaaattacatgataacacagcatataatatagtataatgggcatgatacaggtaataataacagaaaaacaaatctgtttttcagccatgaattacactgtgtctgtggctttgggcaagaagcatgcctgtagttaccctgggctgcaagttgttaaatcatgatggatgatcccataaggaaccaaacaagatcagtggaattcattgatttgccgggtgccctgggaattctttcatttccccccagacctgactgcctcctcctattactggggcagcagttgggctataccacacagactagccatgaagcgggagagaggcccagaaatacaaagccagcattccaggtctagccacaaagattataaaataagcagctctctacatccaatccaaagcaacgagaaggtggttgggtggaggctggaaggacacactcaagaattaaaacttagatctgcaactgctggttttgtgtccgagagtggattattttgcctgcatacagctcagtttttgcattaggaaaataggaatcataatgtctaattcaaggattatttggaagacatctgcttgcaccagatctagcacatagtgggtgctctgcaaatgtctcctttcctcagtaagtttccacacatcttcacctctgaccttcaacttgtaaataaagcagagattgcaatgctgcgtgacagaggagaaaaatgctatctaaaactactactgactgcagctgcttctgtccctaagggagacacattatttctctccagactaaatatattttcttttgcaaaatactttgataggcagctttggttatgaaatgtgaggccccccagggcacagtttagaagaagacagtgaaacaaagaagtagtgaaatagctctgcgttgtaaaaatgaacagagatgccagggtttggcggtatgctaggaagcgcagtgataagagaaagcacattgcaacagcaatccctgttgctgttcttcacctgacagcccgtcctctcctcttccactactttatagctgtcattagaaattaatctggccgagcactgtggctctcacctgtagtcccagcactttgggaggccaaggcgggcagatgacaaggtcaagagatcaagaccatcctggccaacatgatgaaaccttgtctctactaaaaatagaaaaattagctgggtgtagtggtgtgtgcacctgtagtcccagctactcaggaggctgaggcaggagaatcgcttgaacccaagaggcagaggtcgcagtgagccgagattgcgctactgcactccagtctagcgacagagcgagactccgtctcaaaaaaaaaaaaaaagaaataaattatcttcaatctgaggaaaccaatttagaaaaagaaaaataaacaaaataaagaaattatcagcatcttacttactatatagtctacttattcactgtatgtctcttccctcaagaaaggaagtttcctaagggcagcatttatgtgtattttattcattgtcgtttctccagagcccagaagagtgcttggaaaataagaggtattcattatgtttttcttcaataaatgactaagaggggagttttaaagcaaaacttctactgccaaactgcagctcaatgagaatacaaaactattgttttaagtgtgagtttaggggttgtttgttatatggcattattgtagcaacagctgactaatacagatagcaatattggttgcattcagatatgatttaaatcacatcaaagttgcaagactgaggtttggggctcagattctcctgaatttaatcctgtcccattatatcagagcctctcttttctcctctgtagggaataaaccctccttctggagtgatgaaatgataaccttcttcacaggtcactgtgagaattaaaacaccacttttttcataaaaagcactcaataaatatcagtcattaccatctatctactcaaacaattctgatgtttaatgggttcacttattctccaggtaaagtcagtcctgctaaaaaatgaacataagattttgatcctgtacagtgcttgaagttaaaggtatgtaatatgaaataatattttttgaataaattagcaaagtcaaattaattataacacttaaagcttatgaagcaaaatggttatttgcactcattaaaaataggtataacttccttgtttttttgagatgtaatatgaccatattttattaagaaccataaaaaatctttagatattttgatcaatgtctaccttctagaatttatgttaaggaaattattgtaaatttttaaaaaaatattttgtgaatgcacatctttattgaagcatatttggttgcatactactttgaattcagaaatagaaagtcaacagaaaatgccattctcatgcaaataatcaaaacaaattagatgagctacaaagctatttggaaaaaaaaaaaccttcagtgaactaaggacagagaaaaatccaaatgaactaaattccacaaagtgaagatcattttagaggagaggagagatttactacaggtcttatcaaaagcatgctcttttggatgtaaatattttttactttagtctctactgttcttttatacagaattttcagtatacaatcaaacattagaagacatattaatatttttttaaagaacaacaaaaaagtggcctatagttaagagtagaaacaatcaagaaaaacagatccacagatgactcagatgttggaattattagacagggaatttaaaataactataataaaaatgccaaaagcctaacgaaaaatatagataacatgcatgaagaaatggaaaatttcctaaagacacgttcaccaggaaacattagaagaaaatcaaatgggataagtagcaatgaaaaatacagtattagaaatcaataacatcagatgtacttaacagcacactggaaaaaaaacagatgaaagcatcagggactaaaggcagatcaatagaaagtatccaaactgaaacacaaaaggcaaaaatagtggaaaaaatacaacagaatattcaagatctgttggacagtataaatgaatctaacatgatatcaagtgatgtaacagaagttccagaaagagaagagaaaaactggatcgataatatatttgatataataaccatctgagaacattccaaaatggatgaaagacataaacctgtagagccaagaagctcagtgaaccctaagcaagataaatataaagaaaaccttacctagctatgtaacaaccaaaaatcacataaaacaataaacagcaaatctaaaaagcaataggaataaaatgacacattaaatacattagaaaaaaatttatgatggctaacttttcatcagaatctagaataaaagccagaaaacaattaaatgacatcattgagtacgacaagaaaaaagaaatggaagcagagaattctatgtctagcaaaaaatatccttcaaaatgaagatgaaataaagatatccttagagagacaaaatctgagatacttgctgatacttcaggctgagggaaattatatcagatggaaccccagatgtgcagaaaggaattaaaaacaccagaaaaggtaaatatttgtataaatggaaaagaccttttttgacttttatttttacatttataatttctcaaatatttaagtgactatttacagtgtagactggaaataataacgtatgataggattaataccatatgtgtcactgtaacacagaatataacaagagcacaaaaggcaggattggacataagtggaattatactgcagcatgatttttatactgtgaattaggttaaacattgtttgaaggtatactgtgaacatttacatgtagtttctatagtaaccactaaattttttaaaaaggaaatataatctaactatccacagaggatataaaagtaatattaagaatacttaattttcccctgaaaagacaaaaatgaacaaaggaataaagaataaataccataaatataaaacaaataccaagatgggagacataagttgaatcatatcaataattaccttaaatgtaaatggactaactcctctaataaaaagtcagagcttagtaaattggatatgaaaggcaacacccaactataggttgtttttgagaaacacaattttattataaagatacaggccaatagaaagtaaaaggatagaaaaagatatagtatgaaaacaccaaaaataagaaatctggtatgactatgttaatatcagacaatgtagcatttaaacaaagagtatgactggatattaagaagaatacctcaaaataataaaaaaaggataattgagaagaaaacaatcatgaatatagacgtacctaacaacacatttccaaaactcacaaaggaaaaactgacagaactgaaaggagaaataaaaaaaaattcacaatcatagttggagaatgtaaaccctcttggtgcaggttgaacatcccttatccagaatgcttgagaccagaaggattttggatttttccggactttggaatatttgcattatacttactggttgagcattcctaatatgaaactccaaatccaatgagcatttactctgagcactcaaaaagttttagattttggagcattccagatttcagattttcaaattagggatgctcaacttataactgatagaacaagcagatcaaagattcagtaaacactatttgaacaactctgtaaaccaaactgacataatattttaaactactacatccaacagctgcagaaaactcattcttttaaagttgtcatggaacattcagcaaaatagaccatattctggatcatataaaagtattaatgaatatcaaagaatgaaatcatacagagtaacacgatagaataaaatcattcacagtaagatatctagcaaatcccctaagtattgggcaataaaacaaccctctcctaaataacccatagatcaaaaaagaaatcataaaggaaactgtaaaatattttgaactgaataatatgaaaatatatcaaaatttgtgaaataaagctaacgcagtgcttagaagaaaatttatgactttaaatacttacactggagaagaaaggtatatacaaccttccatcttaagaagctagaaaaagaagaagagggtaaacctaaagcaagtaaaagaaaggaaatactaatagtaaagtggcaatacaaagtcttaacaacaatggacaaaaaaaagagggaaagcacaaattgcccacataaataaaaatgaaacatcactacatattctaaaaaatgttaaaagggataaatattaaaacattctaacaattcaacaacttatattaattaatccaaatcacaaattactaacaactgaagacacagaaaataaataaccccatagctattaaagaaattaaatttgtaaaacctttctaaaaagaaaattttccacatatatggttcattagtaaattctacaaaacatgtaagggagaaatatcaatattgcacaaattcggaacatagaggaagaggtatcacttcccaatttaatatagaaggccagcatcaccctgaccccaaaatataacaaagctattacaagtaaaaaaataacagcctaatccctcatgaacataggcaaaaatttcttttttttttttttttttttttttgagacagaatttcactcttgttgcccaggtgggagcacagtggcacaatctcggctcactgtaacctctgccttccggtttcaagcgactctcctcactcagcctcccaagtagctgggattacaggcgcccaccaacacgcccagctaaattttgtatttttagtataaacggggtttcaccatgttggtcaggttggtctcaaactcctgacctcatgatctgccctctttggcctcccaaagtgctgggattacaggtgtgagccaccgcgcccagcccataggcacaaaaattctaaaccaaatatttgcaaacagaatccagctctctctctatatatatgtatacatatctatatatatatctatagatacatgtatatctatagatgtatatatatagatatatatagatacatatatctatagatacatttatatgtatctatagatatatatgcatacatacatataaagaataatacatcatgaccaagcaaggtttattccaagaaagcaaggttggtttaatgaaaatcaatcaatataattcatcatactataacagagtaagagggaaaaccatttgatcatttcaaaatacacagaaaaaaaatttgacagaaatcattatttctttatgataaaaacactcagtgaaactaggaatagatgggaacatctccaatatgataaggttcatctttaaaaacctacagttaatatcataattaataaaatattaaatctttttctcctaaaatctggaacaacaaaaggatgcccactctcatatgctgtgttcagtatttactgaagtttttagccagaacataaggcaaataaaagaaagaaaaggcacaaagttagaaaagaagtaaactgtcattatttacaaaaacataatttgtctaaaacctggaagcaaaactaatatccaaaaatagatcctttgactacatttcagggaatccatttaacagactattctgtagtcatttagaatgagattctattaacagtgctaataaaatggaaagtgtttgctaaaaccagctgtaaaaaacattttaggggaatggtggggaaacatggactggttattagacaattttaaagagttatttttctctttgttagaagtgatggtgctatgtggttatgtgaaattttgcattttaagaaacacattcttaatcatttagaccaaaggttttcaacctcagcactaccggcatttagaaccagataattctttgttttggagggggcagtcctgtgcattgtagtatgtttagtaacatccctgatctctaccagggatgcaggcatgctttcttttgtgacaaccaacattgtctccagacagtgccaaaagtcctcttgcggaggacaagggtcaaaatcaccctcagttgagagccactgatttagggtttaatatcatgatgtctgtactttcttttgaaccacttaagaaaaaaaatgcacaaagaaaatataatattagtgttaattctaagcgataaatacatgggtgtgtattatgctatctttttttattctaccttttacttaggtattttgtttacatacttgttatatatataattttttttagatggagtcttgctctgttgcccaggctggagtgcagtggcatgatcttggctcactgcaacctctacctcccaggttcaagtgattcccctgcctcagcctcttgagtagatgggattacaggcacccaccaccaaacccagctaattttttttatttttagtagagatagcgtttcaccatgttgaccaggctggtctcgaacccctgacttcaagtgatctgcctgcctcagcctcccaaagtgctgggattaaaggcatgaggcaccacacccagccgacatacttgttatatatatactttttattttattttattatactatctacttttctgtttgaaagtttcataataaaagtcaaaataattataatatgctataaatggaaaatgcaatacaattgtatggcactacgattaaaagtatacctaatgctaaatgacgagttaatgggtgcagcacaccaacatggcacatgtatacatacgtaactaacctgcacgttgtgcacgtgtaccctaaaacttaaagtataataataaaaaaaatgaaaaaaatatgcaaaattacatatacaaaaactactcaaaggagtatgttcaagaggagtaagtcttttcagcagtgtgccccagccactccagcgacagtggggatcaatgtaggttggctgtgccacagccacctgaattcactatgatcattaatcctctcctcccatcttttgtgctttaccagctgtataatgaatcctaggataaagtagaaacaaggaggaatcaaagagaatgtaaagaacagtttctccccaagaagaactctgaagatgattcatccttccaagccagatctcttgtcggaaaaaaaaaaaaaaaaagtgactggcccaaagcatatccaagaggaagcattggaatgaccagttgacagccaggacttcccactctagagttgtcattgtcccagaatagagtgacaattaaaatcttggaggagtcacccaagaagcatttgatcttaggattaaatgaaatttatcccctcaatattggagagaagtagcagaacaaaggaacaccctctatgaaacacttaaggaaaatgagaagcttcacagagaaattgaagaaagaacaatgaaattgaccacttggaaaaggagagtaaacaactggcaaaagcggcagagtacagtatatgacagaggcaacccagagactgaatgatgaacctctggataactctgaagcaccagatagtcaggaatttgattctgaagagaaaactggtgaagattctcaagtggaaaacccaaaaattggcacatgcactgagaatcctgtcttcctctacagatgcaaaaccttgcatgtaaaatttaggattcacaattgtcgagatatgaaaccaacctaagtgcccatcgaccaatgagtggataaagaaaatgtgtggtacatatacaccatggaatactactcagccatgaaaaaataatgatataataatgtcattgcagcaacttggatggagctggaggccattattctaagtgaaataactcaggaatggaaaaccaaataccatatatgctcacttataagtgggaactaagccataggtacataaaggcatacagagtgatataatggacactggagactcagaagaggagaggatgaaaagggaatgaaggatacaaaaactacatattgggtacagtgtacactactcaggtgacaggtactaaaatcttagactttaccactatataatttataattcatccatgtaaccaaaaaccacttgaaccccaaaagctattgaaatatatgtatatgtaaacacacacacacacatatgtaagtcttacatgttaaacctattaatatttgactcttgagaaatataccatccagtgggttcacctggccccctgcctagacagagccaatttagcaagatgggggaactgcagtggaaaaacagtaattcacacggagccacgtgtgcgggagacctgagttttattattattcaaatcagccttcctggagcatttggggatcagagtttttagagataatttggtgggtagcggctcaggaagtggtgctgattggtcaggttggagatggtatcatagggggtcgaagtgaggttttcttgtggtcttctgttcctgggtgggatggcagaactgggagccaagttaccagtctgggtggtgtcagctgatccactgagtgcagggtttgcaaaatatctcaagcactgatcttaagttttacaataatgacgctatccctaggagcaatctggggaggttcagactcttggagtcaggggctgcatgacccctaaaccataatttccaatcttgtagccaatttgttagtcctacaaaggcagactggtcaccaggcaagaaggaggtcttttcaggaaagggctattaacaattttgtttcagagtcaaactgtaaactaaattccttcccaaggttattttggcctatgcccaggaatgaatagggatagctttaagattagatgcaaggtgtagttggttaggtctgatctctttcactgtcataatttcctcagttataatttctgcaaaggcagtttcaagtttacctccagtatagttctttaaagcagaacacataactacataatgcaacctctgagatcaaaattctttgtttgaatcctgggaccctattgtattaaaatacaaacactgtatatttttaatttatgatgttttatgtgaacagcattttctcaattgtcagacatgacttgtgtaaatgactaaagaaacttcaatctcctattgaaaaaaaaaagaaatatattcaaggggttgtggatgagtctgagtgtaattcatggttgatttcacttcctggatgttaaagtaatctgtaattatctgcttttatattgaaaaaaattgacaaaatctaacagtgtcaaaatgcaatattattaatcattcatggcctaatattagaagagaattagcagaaaacacagcagagaagagagacttgcagactggaggtcttccatccactacgaagaaagcatctagaggcggaatagctttgaatgggcatacatctgcataatgacttttcctttgttcttttctcactggctaattgagtaactcctacaacaaatatgccttcagacttcacaccagattagagccctttgtaaataaaattaaagttgggaatatgctttccctagctggtaaataaattcaggaagtctgaggtttagcactgcatgccaagatgtctaagtaaatctcaaattcttccatattttgaaataaacaccaaggattatcaaatgccaagaactcccaagaagaaaatagctcacctcactctctgaatcagagaccctctccaatcaaaatgtcccacctgaaaagtagtcttctctcctaccccatcacagacatatggatgttactgatgtcatgtgtgtctggaatattgcctggttcctatgacaagaacaataaaatctcttagtattctgcggcaaacagtctctttctcatttatccacctctgcattgaacatgagtccctcctatgggcccaggcattcttctaatcattggcatcacaatagtgaaccaaacaaaaatgctggtcctcagagagcttagtttttagagggttcttccaaaatcctagcagtggtgaccacaagcagaggatagatcctgggtaaccagagtcaggttatgcaatgcttgtgttcatcatgtcaggataaaaatcttcatctgatttcagactcaccacacggcatcgtcataaggtcataagtcatggactatttgagaaagcactaagctaagaggagaaaaagtgcccttgaacctttctgaacccaatggtatctgcctaagagatggggaagctgaactaggtcacactgagatgagaagggggctccacccatgatgtccttgtctcagaataagtcagcctcttatgctataatatgtggatcaaaagaacaggatgggctgggcgcagtggctcacgcctgtaatcccagcactttgggaggctgaggtgggtggatgacctgtggtcaggaatttgagaccaacctggccaacatggtgaaaccccatctctactaaaaatacaaaaaattagccaggcatggtggtgggtgcctgtaatcccggccactccagaggctgaggcaggagaactgcttgaacctgggagagggaggttgcagtgagccgagattgtgccactgtactccagactgggcaacaagagcaaaactccatctccaaaaaaaaaaaaaaaagaaaagaacaggatgtgggatcagaggagccctccaagacaagtggcttcagttcaaatataagctctgtcgtttgttcagtgtttcaccagacaaagtacttgagtgtcctgcttcagtttccccatctgtaagctgaggtgagcaagaatacttcacagagttgttatgagagataagtggaatgtttcatgggaggcagtaagcacagtgcgtgccacatagtaaacactcaataaatgttagctatttccactaatacagtatagtatatataatataataatgttagctagttatgagtcattatgaacttagttactcacccaaaggccccagttatatcctgaatgcacaccatgtgccaggcatcatgctaactgctgtttatattttcttctttacttcctccagcagcctataatggaagttatcatggtctttattttacaggtgaggatactgagctcagagatgtgaagcaacctgcccaaggtcatgcacccaggagtggcagggtcaagatgcaaacccaggcagaaattactcgaaattccatgttctcttcccaacacaatctctgtcttatttctgtctttccaatgacaccagtatttccaaactttcaccttaccacattctttaagcaacacattatgcagatttcttttttaactggcaacctgaggcaggtctctcttaaccgctgtcagcctaagctcactgctaaagcaccatctctatgtgcccccagacctttgagcactgtcaaaatcagaaatgcattcaccctgtaactcagcaattctacttttggaaatttatcctagaatatacgtacacctgtacacaatgacatacatgcaatgttattcatcgcattgtggtttgtaatagcaaaagatgagaactttcccaattgttcatcaagagagaaataattaaataagacataatatagccattataatagaaaaacatataattataagtaagaatgaaagaactcactataccctgatacagaaagataagcaggatataagttttaaaaggcaggatacagaactgtgtaataaaaaaaaaagaagtgcatatacatttgtatttgcttgtacatacctgaaattctgcaaagataaagaagaaacacataacaatggctgtctgtgaaaaggaaatgttccaggcagaagggacaattttcactgactattctagcatactcttgtttttaaatttttcaatcatatgaatgaccggcctgttcaagaaatgaaacaattttgaaaatacgggttttaagagtataggattaagagtataggattttttttaagagtataggattaagaatcagaaatttgagtccaagttcggggcaaacttggataccttactttatttctatcagccttcatttcttcattagcaaaatctccaagtccctaaatactggggactttggccaacgttatcatagctaccatttattaagtggttacttttgccaagccctatactggagcctcctaagaatttgcctcattgagtcatcgcaagcaaccctatgagataggaactatgattactcccatctcacagatgagcaaactgaagctcagtgcgggggtataacttgcccaaggtcacacagccagtatgtggcagaaccagaattcaaacccaggtctctcaagcctgtatttggactcaatggtttgctgcctccatccacattgacagttttcctagttgtgttccctgcctcttgcataaatcccacccaccagttcccttctgaaattgccagcctccaccaggcctggcccttgctcatttccaatcaccctttatccaccatagctttggaaatggactgttactaatggctagtcatatgtcagcctaatgaatgggaggcagacttccattaaaataatgaaattagcgagttttgaatttggttacatcgcatggcacacagcctcaagtaatgaccaccccatgctccttcctacaaattaaagtcagtttatttatttaaggtctttggcttggccatctctattaagctcacatcatctgtttagggatggatttttttttttttttttttggccttgtttgtttaaatgatgttcgggctgttcccctgattaataaagtcgtaaacacagtcaggagcagcttctgaaccatgtgcaaaagcaaagaatgtaagtcaaagaacaattctttgggggtttgggttttgtttgtttggggtgtttttttttcctccaaaggatggaaacaataagaaagaagctctttgagctccagaaactccaattatgctgacatttctgctgcagaaatacaccaagctccattttgcaggaacccagtgaactagctaatcagatttccttggataatttgctccaaaggtcagctgccttaaaaagcacccagtgcctcattatttggtaaagcaggctgcatgcgggctgcgatttggaactcagcctcccatggcaaggtagtttttctggaattttttagcccagaccctgcagccttagctttggccaaagtctcatccacctttgtgatcagcccgcagacaaaatcattaccagaaaaagcacctgaatctctgagtctgtgaggtctctgtctccaagacaggtctctctcgtgtcccaggagcaccaaagatggcagactcatctgaaatgttcatgccattggtcaatttcaagggaggcttttactgatactgtgatgggtaggcggccagacctaggttctaatcaccaagtccaattctacaaaatccctaaccagtacccctcaaaactatcaagatcatgaaaaataaggaaagatggagaaattgttccataccagaagagactacagagacgtgagaataaatgcaacatgaaactctggattgaatcctggacaggaaaaagacattagtagaaaaactggtgaaattcaaataaaatttggaatgcaattaatagtttccaaagttgtgacaaagacattaacatttttttaacattaaagaagctgggcacaatggctgacacctgtaatcccagcactttgggaggccgaggtgggcagatcacgaggtcagaagttcaagaccagcctggtggtcttgaccaccaacatggtgaaacctcgtctctactaaaaataaaaaaattagctgtgaggtgacgtgtgcctgtagtgccagctacttagggggctgaggcaggagaattactagaaccaaggaggtggaggttgcagtgagccgagatcgtgccaccacactccagcctggtgatcgaacgagattccgtctcaacaacaacaacaaaatttaagaaaaactgaaactgagaagggatttcttggaacttgctatagtatcgttgtaacttttctataaatctaaaattatttcaaattttaaatatctgtatataccattaaaaaatccattgtgtattagttatagtttgatgaaaataagtttaaataatacataattattgttctattataaacttgatatcctagtcctgatatgatatcatagtcttgacatgtgatatcatagtctaaaaacaaaacaacaagaccagagaggaaggtaaagccattcctacaactgaatttttattcaatctcttttaagatcccagcaaagaaaaaaagaaacaacaaaaagtaggactttggttaagctaaaataaaatatgatggatagtctctctctataaactgacacaggaaaatccaagacaaagaaactaggttttgtttgtttgtttgtttgtttttaccactcccaccaacctcaccactctgaaggattgtaatatcacaagaatagcttacaaagcaaacatcactggcttagcttccactctcacagatttttaagacacccagctccaatcctcaccctctgatccttctcatcttgtagaaagagatgcatgaagagtccattgtgaaccaggcattgtgcttgatgacggagacaccaagtcaacttggaccaggtccttccccttaaggagtcttggaaaatttgctcaagagagtctcagctgaatctcgaaggaagaagaggaggtagttggatgaagaaagaaaggaggcttccagaaaaagagcacagtgcatgccaggacatctaaatcatgacacttagatacctgcataaagaggacaaaattgaggtgggaggagttagaaagggcccccaggtaatggccttgtgtggtaaaggatttaactttctcctgaaggagataaggagttttaagcaagcattttagaaagattcagcagaggacagtggatagagggtgaggccaaaagcaggaagactatcatccaggccacacatttctgaatacaatgcccagagacagtgggagagatttctccaaggattctttgcaggaaacaagggtccctgcaatgatgagacctgagtttcctatttctctagtagctttgtagctcagcacccatcccaactgcagctggaagatgtcctctgctatttctccattccatactccaagtccctgccctgcagtatgtatgtaccttttgccacccaccctctgactctgttacattgtatattgaatcttcaacctaaagatctcaactgcttacaaaaaagaagagaattatgtgggcttaataatgttaagggcagttaccacatgagcactgactatatccaagcattgtgttagcctttaacctgcaaagaaaaatacaattatccccatctcagaacataagaggaaaattgagactcccaagaagttaaataacctcctatatagcttttaacatgggtggggataggatatggatttgagaatgtctgattccaaccacccttttatggcacctcactggctcacttttaatttcacttgctgatttattacaaatctccctctccttcagaatcaaacacaaactcattatgctgggccaaaataaaatctgaatggccatacccaattgtttttaaaatgttcagccttccctgacagatgtatgacattgcaacactacagctttggagtggctggcttaacgccaaggagtggttccaaatctcttttccagtggaacagtagcacaaatttggtctaccatctaaaaccaaataatggctgcccttttcctcttcctggaaaaaaatgacatagatgggtaaatggattaatgaatggattagacggataaatggatggatgagtgaatagatggatggatggataaatggatgtgtgtgtggatggatagatggatggataaatgggtaagtaaatgaatagatggataaatggatgaatggatggatgaatgaatggatagatgaatgcaaagtggatggatagatggatggataagtggatgaaagaatggatagattaatggaaagtaaatagatagatggatggataaatggatgaatggatggatgggtaaatagatgaataaattgatggatgcataaatggatccatctatggataggtggctagataataaatggatgggtagatgaataaatggatagatgggtgaataaatgaatacatgaatatacatttacaatatagaatatttctcaaggggaacatagaaaactatcaatagtggttgccatttctgtgaagaaacaaactggttaggacaaggatgggagtggaaactaccttttactatacactcttttgtatctttccaattttgagccatacgtgtataatacctatttttaaaataaatagcaatataaaactaatttcaaatacttttgttaaatgtatatatgaatgggtggacagaagaataaataagtcctaagtttttaaacaaataagattcaactgttattttccccactgatttttctttaaatctcggcactaacttctacttccctacataagaacataatgtaatgcgtatccaccttagtgcacaatcaactacaaaatttggttattcaaatggaatatgtcaataacattgtgttgctttgcaaagagcaccttgacttcaaggtgtgtccgcttacgtctgttcaaggacctctctgcaggagttagagtaagggacaacagtgctgaggcctggacacatgatcccacccaagtttctttttctgttgttggtttttattttgttttgtttttttgagacagggtctcaccctatcacctagactggagtacagtggcacaatctcggctcactttagtatccacctttcggactcaggcaattttcccatttcagcctcccgagtagctgggactacaggcatgcaccaccatccctggctaattttttgtagagatggggtctcatcaggttgcccaggctggtctcagactcctggactcaagcgatctggcctgccttgacctacccaaagtgctgggattacaggtgtgagccaccacacttagccaagtttctttaagccataattctcctctgtgcaagacctgcatactgggcttctgaacactgccccctgcaccatttggggaacataaggaagggctatgagtaaggagaccttgccaagggaaagattaaaaaacaaacaacttccccagccaccatcaatagcatttccaggaagaaataaacagaacggactcttggccataaaggatttatcactttcctttccattggtgtggaaatgaagcagggttgcttcaaaactgcattttccagctttccaaggagctgtgtggattccatatcctagagaagtcgacaccgttctagtaagttggcatggaccccaggtcctacccttaagggcttaatactctgatgcaatatataaaatataatttaataaaagactgaggcagtatttgtgtaccaagtgtctatagcaagtaccaaggtatttgcatggattgggggtggtagcaagtgtgtgatattctccttctaaatcccctgcgtgtggggatggaatttttaacagtgggcgatgtgataggacgatcagagatatgcaaaaccacctttttagtggtgggacacagtcacagttgtattccttctgggactatttggaaatcacacatttctcatcaagtaagaaaatgaaaacagagaaaaaccagttgacagtgatggctcaatagcgccatctcgtggtgatctctgtccccactccaagagcagtccatgggccccaccccttccgggatgttttgccccctctgtatctgagtcccagaaggcagtgcaaaagggatctgggcaaaacagagtatcctacagattggaacagtgaccaacggcatctttaaggaggagaaatttgaaatgggttctaaaggaatagatacccaggcatcaaagagaagcaaagacatttttgatgaagggcatagtgcaaaccaaggttggtggctggaaaatgtcagatcctttgaggatatgaggctggaaagtcagtctgggttggtgaggactcactgctgggctgctgtgggcatgagatgtccttggggaggtacagactttctgcgagacagaaagtcaaaaatcatctccattcacctgtggaccagcaccgtgctaaattacatcacatacatcagtttatgtatgcataaacatacatcagtttatctgccctcaaggggtgatactattatgaacctccacttgacagatcaagaaagcaaggcccaaagaagttaaatcgcttacctgaagtgacttagctaacaagcggcagagccaggatttgaaccaagatctctgcccaacttcaaagcatggtcttgctcttcataaaggtgttctcatctgcaggtctctgctgttgcttgtggcaaagacagttgtcacatatgaaattgctcaatccaaagtgcttctgctttaaatctaaatagttaccaaacattctgccccctgtaaagctgaagtttctcccgaaggcttcaggcttgtgccctaggacttcttgccacctggccagctggtcacagtgtctttgaatgactgggggacagatgtggcaaaatggtaaagtgtgacggttaatttcatgtgtcaacttgactgagctaaaggatgcccagatagctggtaaaacattacatccgggtgtgtgtgtctatgagggcatttctggaagagattagcattagaatctgtagactgagtaaagaagactaccctcagccaggtgcggtggctcacgcctgtaatcccagcactttgggaggccaaggtgggccgatcacgaggtcaggagatcgagaccatcctggctaacatggcgaaaccccatctctactaaaaatacaaaaaattagctgggcgtggtggcaggcacctgtagtcccagctactcgggaggctgaggcaggagaatggcgtgaacctgggaggcggagcttgcagtgagccgagatcatgccaccgcactcgggcctgggcaacactgcaagactccgtctcaaaaaaagaaaaaaagaagaccaccctcacccatgtgggcagacatcatcccatctgttgagagcccaaacagaacgaaaagcaaaggaagtgtacattttctatttgagctgggacattcaccttctcctgaccttggagatcagagctcctggttcttgggccttcagacttaccctgggacttaatgtcattggctttcctcataccccaccttgcagatggcagagcatggaacctagcctccataactgcatacaccaatccatataataaacagacatatatatcctactggttctatttctctagagaaccctaatacaggaaggttgtgaggtctgggatctaaatcccagctctgcccctgagttgttcaagcatagcctgtccaaagctgagttcccttgatctttttccccaaactcctcctcctctactaacccagccaccatcaacgctcctcctccaaccacacattccaccttgcccctcctggaacagagattcccacctcaggacctttgcactggctgttgcctccacctagaactgctttgccctccaatatcaacactgctccctcatgtccttcaagtctttgcataactgtcgccatctcaatgaggccaagcctggccaccaccaccaccccgaactgcacgccctacaccccgttaccttctctgtatttctcatagcagttgccaccttctacaatgccatgtaatttacttgttttgtttccggtttactgtgtgccttcccccactggtatcaatgtgccccagtgactggtagaacctaggtagtaactgaacacgtgttccctatgaaattggtttaactctgctgtatgtgtgaaattttttgtaataaaatattagggataatggtctcaaaggcagtcgttttatctgctttgttcactgatgtatcccaagtgtctgaaacaagacctggctcatagaaggtgcactataaacattactgaatggaggaattaaggagtacatgtgttacttagggcaagttatcttatctccctaaagctctaggtgtcaactacaaaggggcaaaatagtagctatttttcatttattaagtatttattgagcatctactatatatctagaactactatatatgtaggtactagagatacaactgtgtgaaagacagaccaagtcctccttctcatggagctttcaatccagatagggaaacatgaccacaatttcatgtaactccttcatttattacttattgagcatctactatatatctggaactatgtaggtagtagagatacaactgtgtgaaaggtagaccaagtcctcctcatggagctttcaatccagatagggaaacaagaccacaatttcatgtaactccaatgccatctatgagattgcctaatacctgtgtgtcccaactctgtcacagggattcagggaggaccactcagctgagtggcatcaaaactgagcactgaatcttaattgttaggattctgctaataagaaaaatgcatctttattttgctgagggcaacaatgtatccagctaaaaatcatctttcactagcatctcttgcagctagggctggccatctgacgtagttgtgaccagtgaaaagaagggagagcgcacctttagttttctgccttgctgccctcccttggcttctatgcctgctgacgtgatgcctggagatgaagcagctattttgtaaccatgaggatagaaattgcacagcagagcaagaaaatgaaaaaagtgggggtttctgatggtctctttgattcactctaccaacatggcttgcctactgtttagcttattgtgtaagccaaataaacccttgcaccttcaagccatgataatagagttttctgatacttacagccgtatctgttgtcccaagcaagatatgaacgaggttaagaggatgaaagtgaaatgtactaagcccagggcacagcatgtgcaaaggaccagaggtgtgagtgagcaaagtcaattccagcaacacaaagttcagggcagctgaagtggagtgggcaaaaagcaggtggtgagtgaagagtttgcaagagcaaacagggatcccactgaaatcaaggttttgtaaatcgaattggagaaacagtgaagagccatagcaagctgctaagaaaaatttgagttaatttatggaaagtgtccaatgcacagtgggtgcccaagatataagcaccgtgagtatcatcttaccttggaatacacacaaaattaactcctccgacaaaatgaagatgcatcacttttatctgcaagcccgccggaggtcacagacacgtgcagagggaaaacagtatggtgagacggagaaaaacaatccagccaggacagttacaccgacgctttattcatatctgccaccatcgggattgattcccacacagtgactcactcacagcaccaacctctttaatcaactgtgctgagcagtgacatccaagctcacctcggaaaacgacggaaactccaaggcaaggtggcctcccgaagtggccttttcccttccctcctcatccctgggctgtttccagcagacggcagtgaacgcctaaatgagggtttgatcaatggaggccaagctgatattgacaaagcagctgcagtttccgcaaatcacccagcactcatagatactgaagattaatctttacaaatacggggcaaagggggagagaaaaaaccaagtcgatttagtttccgattattactttctccagaaggcactgaagagtcaaaagtttaactgatgtacattagacagggagacaaatccagaaatatcacccaattacccggtagcttctagaaggtatttttcatgacagcaggtgggtttgccttttctaaatcaggaaggagacaagacaccgctaagaggatgttgacttggcccagcgcacaagcactaacctcaccggacaaatagaagcctgaaaatttgtcctcagtctacacggtccccatgaaaacacatttccaccgatttcctagttatttctgttttatgcctcatgtttagaaagtaaattgttccttcctggaacaagatggacttttttttaactacaaagaaataataaataagtgcttagcctccctaggcctccattttcacatccaaagagtgggtacagcccaggacgtaatgtttagagggcactgacaccatctagagtggatcattctctaccgtgcagggctattccgcccactgcaggatgtttactggcatccctgaagtctacgcaccagatgccagtagcaccatttcctcatccccagttgtgacaactgaaaatgtctccagacatgaccaaatgtccctgagagacaaaaccacttgcatagtcacgaacagataacacgactaagaatggggaaaacgtgaatcaaaagatgttccatgctgtgttcacataagcaataaaaccaaatgcttgaatttgatgctagttataacctttttattcatgtccatgtcacagccaaagaactgtttttgttttttaggttttttttttttgcagagacagcatttcatttatttcaggacactttcacagaagtattcatatattctggcaaaatgaaatcatatattacacaaacatttcatttccatagttagtacagaagaggaaaaattatttgtggtcaaaattactcctgagattcctttaaatcaaccataatttatagagtgcgcatgtacttgtgtatgtaatcattttaagtcataactatgcccctcgaacagttggaagtcactgagctggaccgaagaattcacaaaagagaaagctcttcacagatacttgggttttgaaaccattctgccattagatagctacctagtcctcaaggtgaactaagcacgatggaggaattccaagtgtggcttcccacctgcagggtcgactccactgagactctgctgctaacctcagcatacaaccctagatgatcttgtcgtgaagatgaaggagatcacagacaacatcttgccagggactgagttttaatgctggcgttttagttatcctgttgggctacaaaaacatgtcaggcaagatgttaagttttgtttaaagcatcaagaattccaggcccggcgcggtggctcacgactgtaatcccagcactttgcgaggcctaggcgggcggatcacgaggtcaagaggtcgagaccatcctggttaacacggtgaaaccccgtctctactaaatatacaaaaaatttgccgggcgtggtagcgggcgcctgtagtcccagctacttgggaggctgaggcaggaggatggcgtgaacccgggaggcggagcttgcagtgagcagagatcacgccactgcactccagcctgggtgacagagccagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagacggagaccaccctggctaacacggtgaaaccccgtctctagtaaaaatacaaaaaaaaaaaaaaaaaatcagcggggcgtggtggtgggcgcctgtagtcccaggtactcgggggaggctgaggcaggagaatggcgtgaccccgggaggcggagcttgcagtgagccgagatggcgccactgcactccagcctgggcgacagagcgagactccatctcaaaaaatatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcctgctatgctgcctggggtaactgcacaaggccccataattagacgaccccactgtgatgctggcattttgaaattcctataatttttttttttttttttttttgagacaaggtctttctctgtcacccaggctacaatgcagtggcatgaacatggctcactgcagcctcaacctcctaggctcaagcggtcctcctgccttagcctcccgagtaactaggaccacagatgtataccaccattcccggctgatttatttatttattttttttttaatttattcatttttttttttgtagagatgcagttttgccatgttgcccaggctggtctcaaactcctggactcaaagcaactccccagcctcagcctccaaaagtattgggattacaggtgtgagcccctgcacccagccagaattcctataattttcataacaagaatccccacattttcgttttgtgctgggccctgaaaactatgcagccagtcctgcccaggatgcttattttatttcattttcccagctttagaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagagcctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcgcttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaagacctactacttgatagcacaacagagtgactatagtcaataatttaattgcactttttttttttttttttttttttgagacagagccttggtctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccgggatggtctcaaactctagacctcgtgatccacctgcttcggcctcccaaagtgtgaggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccgtaaatatatacatttattatatacccacaaaaagtaaaaaaaaaattttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaataaaggaggagagctttctctctaaaaatctaagggattccaattaaaaatcacctctcattgtacatgcagaaaatgtacagtgagacacaaagatgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacgttaccagttagattttccaagcacagttcatactgcagaattcacctaacttgatttaggtttctcctttataatcagtttccacttgaacttcaactaccacgaaaaagtaagtaagtaaagcaaagatgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgcaagaggtttattccaagcctctgacagtaggagtcctgaaatccacctggtggatgaaggaggagacaaaatttagaggacttggcagaatcacagaatgtggggagatgtttccaaagggggcctcatctcatgctgcaaacgttttgtctggagaataccaaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaattcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcaatagctgagtaggtttcctgcaggcaatgggagacgcaaagttctgcacttaagctcctgtaggggaaaaagcagagccagcgtgggttgggggcaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggacaggaggaatgcttcagcccaagagtttgagaccagcctgggcaacacagtgagactctgtctctacacactttatttttttttgttttttttttgtttgtttttttaaattagctaagtaggatgctacaggcctgtggttccagctacatgggaggctgaagtgggaggatcacttgagcccaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctttgttagtgtactggtatggaccagtagggtccatacttgcacaaatcccaacaatcggtatttacatctctttgcttggccagggcccacaatgcctgtgcacaggacaggtcagaagtcctggagaattaacatacctcctgcattaggtcttcaccagtgactaactggagggatgtataaatatcccagctccttcactcctccagggggtgattctgagctacatgctcaacactagggttggcaaacttcttgaaaaagggtcatatagtaaatattttatgttttgccggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttcgccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatactcttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacatggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttgtttatcaaatacataagaaaactcatttaatatggttattttgattgcgtgtgctcttgggttttagctccctaatagccagagcaaaagaaaaagaaaacataaaggacacatgaatatcatcatttaacaaagggaagtatagctgttcacaggaaaggaaatgatttttcttagaatagaattaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctaaccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttggtttagacgaggtcacgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttatattagtccattctcacactgctaataaagacatgcctgagactgggtaatttgtaaagaaaaaaaggtttaatggattcaagttccacatgttgtcatatgccacacttcttagggatgaatgaacatcaccatgatgccacacttcctagggatgaatcaacgtcagaattttttttttttaagttctgggatacaagtgcagaatgtgtaggtttcttacgtaggtatacatgtgccatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctctcttctctccccgctgggctgggcttcaggtgcctcctatatgcttcctccatatcacctccacccttgcttgtcattgtctgggtttgaattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaacttgcttggagtggcatcaccccaatctctgcctccgtctggatatcaccttcttgtcttctgggtgtaatatctctccgcctttctcttataagacacttgcaatcaaatttagggcccacctagataatccagaataatctccccatctcaacatccttaatttaatcatacctgcaaagactccttttccttataatttaacatatacaggttccgcggactagaacctgatatctttgagtggccatgattcagcctactataggtttcatcactatctctttatcaactctgaagtccttaacagcagagaccacctgtggccattttcaaatggctgtacattttttacatcaaagcaatctcttagggccaggcacggtgcctcacatcggtaatctcagcaatttggaaggccaaggcgggcagatcacctgaggtcaggagttccagacccacctggccaacacagtgaaaccccgtctccactaaaaatacaaaaattagctgatgtggtggtgggcacctgtagtcccagctgctctggaggctgaggcatgagaatcacttgaacccaggaggcggaggttgcagccagccgagatcacaccactgcactccagcctgggtgacagagggagactccgtctcaaaaaaaatacaaaaaacaaacaaacaaaaacacacaataatctcttgggatctacaccctctcccttgactttaatgacctccatgattgctttgatgtattgaatatggtggaaatcatactgtgcccttttccagtccatgttttaaaagactatcaagcgctacttcctatatcttgaaatactcacttttggaactcagacaccactatgctacgagaagcccaaaccacatagaaaggccacgtgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacgaaactctagaagctatggattctagggagttgagctggagatcaggaggaatggatattaggtctcaaagaaatgacaaggtaataaggtagaagaagaaggctgtggataaacaaattttctggggccttaatggtggtgagaagtgggcaagttcaatgttgagcaggaccaaattcaacagaccctcagcaaatgtttgctcacttagcagtacacagattctgcatacatcttccttccttttaaccattcctttaattgtataagcaatatattgagtatctactgagagccaggctttgagttgggtgaagactattcagcagttaagtccctttaatgcttatacactgttgatgggaatgtatattagtccagtcactgtggaaagcagtttggaaatttctcaaataacttaaaatagaactaaggttgaatccagcaatcccatcatgggtataaatcccaaaagaataatcattctaccttaaagatgcatgcacacatatgttcattgcagcactatttacaatagcaaagacagggaatcaacctagatgcccatcaattgcagactagataaagaaaatatggtacatatacaccatggaatatactatgcagccataaaaaagaatgaaatcatgacctttgcagcaacatggatggagctggaggccattatcttaagcaaattaacacaggaacagaaaaccaaatattgcatgctctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttacccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaagccagaccattcaatgctattgcttctctcttccaaatgggatgaagtgcaggcagtaaaccagggaagatgaacttggccaagtccttctattcattttgtggcagtgatgacaatttcccattgtggggagctggaggggcagtctccttctgttcaaacgactcagcacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctctttccccaactcatggttcttaagaataactgaagaatgtgctagaaatgcaacatcttgagatagagagggactggccagaacgacccaacctctgttccagtccacccctagaaacaaaatgtcttaaacactttagcccagcaaatcacacatcctggggtataaaacacagaaccagctgctttctggggtatctgagcttctgtgtaagtgaggcatgcacagatatgactctacttaccctcagcaggtttccggggacttggaggaatagctcacaatgaatcctaggcttctaccatctcttgctgcctatctgtaagtaataaacctacctcatgtaacttgttgtgtgggagtgttctgtctcactggacaagttggtagccagtgaacagtgaacctgcctcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggatcttcccagccagtgactgggcacagcggaagtaatggaattaggtgattctaacccaactgggagttgtccaacagagagagttgccttaggaactattacggctggctgatacattctcagagttgtgctgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgttcctgtgatcccagcactttgggactctgaagcgagcagaccacttgaggtcaggagttcaaaaccagcctggcaaacatggtgaaaccccatctctactaaaaaaatattagtcgggcgtggtggagcgtgcctgtaatcccagctacttggcaggctgaggcaggagaatcgcttgaacctgggaggcagaggttgcattgagcagagatcatgctactacaaatcagtctgggtgacagagcaagattctgtctaaataaaataaaatgataatagtaataataatgcagtttcaaatagctagaaggaagatactgaaagttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaagaaatatagaatgttatacttgtaaaaagaagaaaatggaaactgaggaatcaaattatgtaagagtgatcttccttctcatcagctatcattttagaaatttgtaggaaaagaggagataaaggaagagagcaagaggaagcaaataagcagagggaggaaaagaggagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcggaggttacggtgagccgagatcgcgccactacactcgagcctggcaacagagtgagactccgcctcaaaaaaaaaaaattagtaagagaatgagaacttcatacagaagttgagaagtggatttgaaatcagtggagactgggaccttgtacaattaattctgttttgccttctgctactcagaggacctgaactgactcacctaccgtctagagacagctactattttgtatttcttttttagtttcatgcatttaatttgcatgattatcattttgctttatttccccattttacattataatatgtgccacctcatgttactgtgcttcatgtctattattgatgccccataacattccattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagttgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttcttttttttttttttttttttttttgacacagagtctcactccatcacccaggctggagtgcagtggcatgatctcagttcactgcaaccttcgcttcatgggttcaagcaattctcatgcctcagcctcccaaaagatttccatgtaaggtgcttgcaaagggaaaaataacaacttgtgtggtcaaaaagtttagaaacccctggtctaaatggcgttagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccagatcaaggcacaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagtactttgggaggccaagatgggcagatcacttggatcaggagtttgagacagcctggccaacgtggtggaacctcatcgccctaaaaatacaaaaaaaaaaaaaaaaaattatccaggtgtggtagataattatccagtagtctcaactactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaaccctcagagtgccactgttcaagctcctcttgctccataatcactttaaagaggctgcccccacccctggggctcagagggcttcctgtgacctgacactatgatcgtgagcgagtgccgcgctctgttcccaactatgcttcctcatctgtcatccatggcttttcttttaaggagttatttacgaagagctgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgacaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatttatcatgttgaatttctcatctcttgtgaatgccacgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatctccgaattctattcatgatagaatgtttgagcatctgtggaccccagtttgtgaactcttgccctgaaacaaagcctgccagttatctgtgttcaatcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaaaacaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataactaaactgcagaggaaagagacgtaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccagtgctgctttgcttagctaactcctactcatcctcaggtctcagctcagcaaagtcacttcctcagggcagtcaagctttgccactcatcaagactaggtaaaattttcttgttaaatctatttatggattttcctggttctttgtatttttcatcatcttagataggttagatttccccagaaacaaatcctaagagaaggtgagatggtttggctgcgtccctacccagatctcaccttgaattgtaacaatctccatgtgtcaagggcgggggcaggtggagataattgaatcatgggggtggtttcccccatactgttctcctgatagtgagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagtacccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacacgtgaaaaaatgctcaacatcactaatgatcagggaaacgcaaatcaaaaccacaatgcgataccaccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactgtggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaaaaggggtgtctaaggccctctctgacattctaacaacccccatcatctcttttgctggccaggggcccacctggtaggacagtccaatccagggtaattctggctcacaggtcacacaataccaatctttggtcccaaggttaggagtggctgctcccacaatggactttataataacctctccaacctctgtttgttgagcttagattcttaagcctctaagcttctgatgactcttattagagaaagtaatataattacccatcaataaagaaatggctcattcagcaaggatatatctgttcaatcaaatatatctgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccgtggcccacgcctgtaatcccagcactttaggaggccaaggtgggtggatcatgaggtcaggagatcgagaccatcctgccaacatggtgaaacctgtctctactgaaaatacaaaaattagctgggcatggcgacacgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggctcatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcaagatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatacacttctttggttttgctcttcctctttctctctttcccttatccctgctttcttgagattgcgtgacccaatgaaacatttgcatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaatttaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaacaaagacatacctgagactgggtcatttttacaggaaagaggtttaatggactcagagttccacatggctggggagcctcgcaatcatggtggaaggcaaggaggagcaagtcacgtcttacatggatggcagcgggcaaaaagagagcttgtgcagggaaactccctgttataaaaccatcagatctcatgagacttactatcatgagaatagcatgagaaagacccacccccatgattcaattacctcccaccaggtccctctcacaacatgtgagaattcaagatgagatttggatggggacacagccaaaccatatcagtgggacaggatggaagctgggctcagagcaacttctctccctttccatgtcatctcagagtctctccaggtttccctccagcaaaagccctcagatttcttacacagtggatcaggggtttaaaaccaagagttccaagaggtgtaaggtggaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaactgggaggaggggtgggtggaagactgaagcattagagtaagaggggctccttcatcctccggtcatcattttccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaaaagcctcataagcatcttatttggagttacagagataaataactgaagacctaaaaatggaaacaacatttcaagcacttgcctccgggaaataagacttaaggaggggagagaggagagaaggggccaggaaccgctgctttcattggcagctcctctgtactttaactttgtacgatgtgctcatattactatgattttttttttaaattcaaaagggaaaaaaataagaacaaaatgatgatggttatttttaaaactatgtaattaaacctggaaaaatctcattttgctaaacggaaaaaaagtagcaggatacgaaactatattaatagtatggtcataagtatgtttaataaagaaagagaaaaacatatatgggaggagaaaaatctgaagaaatttacctaccaaatgatagtgggtgggtttctctacttttctaggtttcccacattttcaacaacgtgattctcatactttcctaatgaaaagaaatacattccttacataaaataaattaactgggccgggcgtggtggctcatgcctgtaatcccagcactttgagaggccaaggcgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaatgaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctaaggcagagaattgcttgaacctgggaggcagaggttgcagtgagctgagatcgcgccactgcactccagcctgagtgacagagcaagactccgtctcaaaaaaaaaattaaaaaattaaaaaataaaaataaaataataaaataaatgagccgagcatcaattaaagaaaatgccagaaggttctctgaagaactttccacaatagaagtgtattttaagtccctgagccttcatctcatacctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacgggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggaagatagatcacttgatcctgagagttcgaggccagcctgggtaatatggcgaaacctcatctctacaaaaagtacaaaagttagctgggcatggtggcatgcaactgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaaggggaaaagctgttgccagtacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttagaagagttataagaattaaactagagaagtgagcattgtttatatgtgcttgttgctatggatccaaaactgccagtaataacaataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccattcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcgaggcagaatacactccagagacccacgtgagatcaaggctagccttagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccaccaagctgcaagctgcaccaggttcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtgtatttgttctcacgctgctaataaagacctacccgagactgagtaatttacaaaggaaagagggtgaatggactcacagttccacatggctgaggaggtctcacaatcatggtggaaggccaaagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccctgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcaaggagacaggctttccagccttggccttcgggagaaagaaagagagagtgaaaaaaacatgggctttaggcctgacgcgtggctcacgcctgtaatcccagcactttgggaggccgaggcgggcggatcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcgctgttgcacaccaacctgggcaacatagcaagactcggtctcaaacaaacaaaaaaaaggggaggggcagggctttagacagatccaagctcaaccctgcaagttgccgggactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttacccacaatcaaagaacttctacaaaatagaaacagccccctgccccctcctgcccccgcccacctgctaccttaataggttatttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcatttgtaggcagaatgggttttcttgagaccattacaaacagactgcctaaattgcaaagattccaggcttgacagctcccggaggactccagatggaaagaacaccacccccatctcttatacatccaggctgctgtctgtggacgtccgaaggttctcccaccacccatgctattattgaaattccacaatcaacctgcaatgccccagtgaaccattttgctgggatgggaggaccaacttagggccagccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagatgacaggctaggataattgatcattagaacatctgtgctgtttttgttgtaagaatagtatcaatattaataacaacagctaatatatattgagtggcttctggagccaggcactgtggtaaacttttgcacgtatcctctcacttaatcctcacagtgctctacaaagtgggtactggattcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgcgagctactcaggaggctgagacaggagaattgcttgaaccccgggagacagaaattgcagtaagccaagatcgtgccactgcactccatccagcctgggcaacaagagcgaaactccgtctcaaaaaaaaaaaaaaaaaaaccaaccaacaaacaaacaaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggggaaatcaagctaattaacaagtggtggggatgcttcaaatttactctcttggcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcatctgaggtcaggagttcaagaccagcctggccaacatggtgaaacctcatctctagtaaaaaaaaatacaaaaaaaaaaaaaaaaagctgggtatggtggcaggtgcctgtaatcccagctactcgggaggctgaggcaggagaattgcttgaacccaggaggcagaggttgcagtgagccgtgaacgtgccattgcactccagcctgggtgacaagtgtgaaactccatctcaaaaaaaaagataaaatacaaatacatccatatataattaaaatatgatagtggtgtgttttcctgtttaacaaatatttacttccctctcattcccttcaccatgggaagaacagaatcctctgccccgttagtgatgggtttgttttggccaatggaacatgagcagagctgacggtgcaccagttcccagcttagaccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaaaagtgtttatttttataaccatgagggtggtgttacttgttacacagctacaggtaactgatacatttacacgtgaatatgtgcacatactatacatgtgcatattatataggatacatatgtgtggccgtgttacatggaaatagatacatataaatccttaaaatgtatctccatatgtgggatatttatacatatctatttgggagatagtaaatgaggtagaatttggagactgctaaatttgcattcttgcattgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggggaaaaaagcaaaaataaaaaggataaggagagccagcagccccggaggaggagggaggcaggcataggatgtgcctgtgcctggcacgtagtaagtgctcaattattggtagccatttttattctcaaagtgattaacgtgagaacaagggggtcagctggagatttaaaaaacaataatcagtctctctgctccgcagcagacccctgagacccttggcaaaccccagcaatagatcaaggaccttcagtaggtgaatacagtcgcaggaactgctatagctgacacatagtccctgcaactccagccagacgccagcaccagctgccactgggagatgtgagcttggcttctccatgaaagagaaagattcctggggcctcagccatgcctcaaacccactgataacatcaaacacacattgctggggggagccggccaggtgctcagaagctgcagggtgaccctgcatgtaggtgtcgggaagtcagcagcgactcgcgggtggagaaacacccacgcctttgcaaacactcttaatgtaatgcactgcccttgaggccacctcccgtttttttggccctaattggcatgtttttctgtctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaatcttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcaattgtgattagcacagagtgaagcagcgtcattctctcgggggtaatacctgagattcgttgcctcataccaaaaacattaaggacacagacacacacaaagagtgagtttaaaagcagaggtttaataggcaaaagaatgagaaaggagaacactgtctctcttccgagaggggggcacccagtgggacttctggcccaagtcagagtgcaccagattttacagggttggggaggcggtgcctgatttactagggcccaaagattggttgcaccaggtgtgacatttacatagcgcatggggaagttggccgccccaccctagtgttactatgcaaatggggtctttgcctggctggctccttgttgcctgctccttactgtacacatggctggcaaagagaagggaagatggaactgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggttactagggtgactatccatcctggcttgagcactgcaagtcccacactctgggaatccgctcaggcctgggcaaaccaagacagctggtcaccctcgccgtaacataagtgagtaaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgttctttactggggagtctggggacagccctgtgccttgtaggatgtttagcagcatccatggcctctacatactggacgacagtagcacagtataccctagttgtgaccatcaaaaatgtctccagacattgccaaatgtcccttatggggatagaagtgtccccagttgagaaccagtgtcgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaagtggaacaagttctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcatgggggcagatgcctcaggaatggctgggtgccattctctcaagagtgagtgatttcccactcttagttcctgcaagaactgattgtgtgtgcgtgtgtgtgtgtgtttcaagatggaatctcgctctgttgcccagactggagtgcagtggcatgatttcagctcactgcaacctctgcctcccggattccagagattctcctgcctcagcctcccgagtagctgggattacaggcacccgccactacatccagctaatttttgtgtttttatttttttctatttatttatttatttatttatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtacagagagggtttcgacatgttggccaggctggtctcgaactcctgacctcaagtgatccacccacttcggcctcccaaagtgctgggattacaggcataagccactgcatccggccgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatgttggtgccatgattcttgcagaatgatgagccaaataaactttttttctttgtaaattatccagcctcaggtgttcctttatagcagcacaaacaaagacacttgctataaattgattctgttgctcactttttttccccttgtgctttgtttttaagatccatccaggccgggcacagtggctcacgcatgtaatcccagcactttgggaggctgaggtgggtggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaataaaataaaagatccgtccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatccttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtgtcagatctctctagaatgaccgcgccagtccacagtccaagggcttgcttttagagggggccaaaccccactggcccccctaacacggtgtagacttgcagggctctgctgagagccaccattaaccacaagcatcatgtccgtattgctaccgttcgtcaatacccttgaccctcttgccttcaggaaccctctatttccaagcacatctccaaatcagagccccaccccctccacaatgcaaagtgggaccatctagaagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccaccccactcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgagttgttttccctcaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggaatagacacggcgaccctaaagtcctttcagctctgagactccatgtcacgtgatgtaatgtaacagacagagccctacctggttccaatccaagctctactactaaacgagtgatgagatggctcaccaactgtacctaccactgactagctgtgtgacccttaactaactgtacctaccactgactagccgtgtgacccttaactaactgtacctaccactgactagtggtgtgacccttaactaactacacctaccactgactagccgtgtgacccttaactaactgtacctaccacagactagccgtgtgacccttcactaactgtatcaaccactaaactatccatgtgtcttttaattgtatctaccattgactagtcttgtgacccttaactgtctgccactgactagctgtgtaacccctaactaactgtacctaccactgactagccgtgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagccatgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtgacccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactaactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaacagcagctgcctctggggctgtagtagggtgaccagccatcctctttggtttatctaggaccgaagtggttccaggtatagggaacgctcagtgtcaaatccagtaagtgctaaagccaacacaagtttgtcacccaaggttgtagtgagaactaaaggtgaatgaggtgacatggataaaatctagcacatcaatataagttagtgtcattactattgctattgctattgctttttgtttgtttgtttagagatagagtttcactcctgtcacccaggctggagtacaatggagcgctctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcaccctctgttcccactacttcaggccctcaccacattggccaggctggtcttgaactcctgacctcgtgatcctcccacctcagactcccaaagtgttaggattacaggtgttgagccacagcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtatgggccctccaaaaggtttaatgtctctgtggtgtcatcccaaagagaagcacagagaagcaagaggatctgcagctgaagagcccagaggcaatgaacactcaccttgactctcttctcatttctgaggctctatcagttaaggttcttagtttgcaagcaacagaaccaaatcttttttttttttttttttttttttgagacaaagtctcactctgtcgcccaggctggagtgtagtgcacgatctcggctcactgcaagctctgcctcttgggttcaagcgattcttctccctcagcctcctgagtagctgggagtacaggcacacgccaccatgcccagctaatttttgtatttttagtagagacggagtttcaccatattggccaggctggtctcaaactcctgacctcgtgatctgcccaccttgacctcccaaagtgctgggattacaggcgtgagccaccatgcccagccaacagaaccaaatctttacattaaaaagcggggagcttacaggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcatggtggcttatgcctgtaattccaacactgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgaggcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaaggtgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgccctcgaacaagatcctccagttagcgttaagcagattaaaggttgagaagcactaggctgcagggtcatggaatgactggactctaatcactctacatccttgatgatctctccttaagatgcaaattcccagaaggcaggcatttgatgggccatgcttttgtcacaccatgatagaagatctgggcataagaaattctgcagagtggtcccaccagacccacaggcaggagaagggccgtccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaactttagcatggatcagaatcacctggaagatttgtaaactcacagacttctggaacctaccctcagagttgctggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattaggcaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtccttaggagggagagactgggaaacattaataccagagccctggctattatttgcaatgtatagcaatgtttttcctcaaggtagatctttggtgagctgtacacagtaaagctagccattcaggtggaattacatccaactagtcatctccgtcatactaaaacagtaaacaatgcttgaagaagtcagatgcctggcatcaaatctaagatccaccatttactggctgtggtcattaggcaagatgcttaacgtctttgttccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaacaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacatggggcttacagctccctccctcgacgcgacacctggtgattataattcaagatgagatttgggtggagacacacagccaaaccatatcacctattttatttatcataccattattgttattattattattggtggatgtgctggtggcgttaatattgttggcaaaactggaactagctggatctttatcaataattgcaatcatgattctgacatctgaccctttcatgccactggtaggcatgtaaacaggcacaatttttctggaaggtcatttggcaatatgtatcaagagccttacaaatacgcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttctgaaattacactatgttcgtacaatgaaatcttcttccaattattaaaataatgttcatgccttttaattggggtgattgtataattttatatctttataaaaatatatgtatgtaagacttcatatagatgatgaactcaattatgtaaacatatgatagaaaaagagaagggaataatccaaaagccatctgctctgggtcttagaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaagcccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatagttctcaaccaggggtgattcctcctcctcccctcaggggacatttggcaatgacaatggggcagggggttgtgctactggcatctagtgggcagagtgtagggatgctgctacacaccttacagtgcacaggacaaccctcacccaaaggattatctagcccaaaatgtccacagtgctgagactgtgaaacccagaattaggatgaccttataagttatcgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacagagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgccgcttcgaaaagctgtctctggcatggcccctactgcagcggcgcgtgacagactgccttgcttggtggaaggaatcccaccccaattaaattgctggagccctgctgggaaggaggtggaggcgggaggagaaggagagtagggagccgggcaagccactcctgcctctcctttttcatctcggaagagccaatttcaagcttgcctcgggtcataaaagaaattaatttgattctctcaaccttgctcagagtggacacacgtcttcggctggagcatctgctgctgctggatccagagcgaggagaccatcccctcgaaacgattccatttctgttgcaaggcagggccaaaatcatctgcctggagctggagaagcagctgcctggaataccctgggctgtcatttttgctggtaagatcgaaaaacggttctcacagctaaggtgactcccaagttgcaggaggtttacccagagagatactcatgggtagggctggttcttggaaaactcccaaacagaatttagcagtggcagctgcctaacccacttcatattgatcagcttgatcacactgagtcctcttaactgtcaggcatggcccctgggctgtattcctgattgcacacagctaaggtgactcccttgtacaagcctccccgcctgagagaggatggaacttgtgacctgcttctaatcaacagaatatggcaaaggtgccgaatgtcactctcttgatcatatttcatcaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgcgcgtgaaggcacctgcctgtggtcccagctacttggcaggctgagatgggatgatcccttgaatctaggagttaaaggctgcagtgagctacaacttaccactgcactccagctcgggtaacagaacaagaggctgtctcaaaataataataataataataataataataataataataataataataataattttatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccctcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccacgtggctgtggaggcctcacaaacatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagacttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcacttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgtcctcaatctcttctttctttctctctctctctctctctcactctctctcccccatcttctcgctccccatctccctctctccctctctctctctccgcccccccatgtattactctgttttcacaatgctaataaagacatacccaagactgagtaatttataaagaaaaagagtggtcacggactcccagttccacatggctttggagatctcacaattgtggcagaagacgaatgaggagcaaagtcacgtcttacatggtggcaggcaagagagtgtgtgcaggggaactcccctttttaaagccatcagatctcgtgagacctattcactatcacaagaacagcatgggaaaaacccgccccacgattcaattacctcccaccatgtccctccgatgacatgtggaaattatgggagctacaatttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttctgaaggaggaatgggggtggacaaaaattattggctgagaaaatagctggtgaacgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctatgtctcatatctttgggagcatgggtggtttcccccaccctccattttcctcttctctctgaacaaaagttttagtttgtgaagtcaaatctcatctttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacaccttgctaatttttatatttttagtaaagacagggtttcaccatgttggccaggctggtcttgaactcctggcctcaggtgatccacccaccttggcctcccaaagtgctgggattacaggaatgagccaccacacccagcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacactgggggttagacttcagcctatgaatctgagggcaacacaaccactgtctgttagttcacggcagacagtgaaatagtggaaaggagggtgtgattgattctggggagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagagtatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcttccttccttattgtacttattgtctaaccttaaggtacttccttatggtaccattttcacacgctgataaagacatacccccacaccccagactgagtaatttataaggaaaaataggtttaatggattcacagttccacatggctggggaagccttacaatcatagcggaagacaaaaggcacatcttacatggcagcaggcaagagagaatgagagccaagcagagggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaattacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcacctggtatatccatcagagaccaccaatgtgttcctgtcactccaacaggaagcagagaacccaaggctgtgttggcaagtagaagaccctagggacccagagggcccagagagcccagggattcccagtgcaaaccctcagatgccttggtgccttaaggaaaaacacactagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttaatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagactgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaagagcaagagaaagagagaattggatgcatgctataacagcctatgatggtagatccagctggtctggggaaaaaggagagtatccaactaggcttccccaaggtcatgaatttttttttttttttgagacagtctcactctgtcacccaggatgaggtgcaatggtgcaattacagttcactgcagcctcgaccttccaggctcacatgattctcccacctcaacatcctaagtagctgggactacaggcatgcagcaccacatgcagctaattttttgatttttttttcttttggtagagatggggtctcacttcattgcccaggctggtctctaactcctgggctcaagcgaacctcccacctcagcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggcaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccgttacctatgacatcttcctctgaaataagctcaacagaagatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccagtagttttctcccagtggagttagaaggatagctcctaatgctctgtattagtctgttttcatgctgctgataaagacacacccgagactgggtaatttatgaaaaaaaaaagaggtttaatggactcgcagttccacgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacaacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttctgggtagcagagtcaacaaatggaccaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcccgggctaatgctatcctcccatctcagcctcccaagtagctgggggcatgtaccacatctggctaattttttgacttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgtcagcatagctagaatataagcaggcagagcagcatggaagggcttgactggctgagtcttccagccttcatctttctctcgtgctggatgcttcctgccctcgaacatcggactctgagttcttcagctttgggactcttggacctttgaccacagactgaaggctgcactgttagcgtccctacttttgaggctttgggaattggactggcttccttgctcctcagcttgcagatggcctattgtgagagctcacctggtaatcgtgtgagtcaatactccttaatcaactccccttttcatatacatctgtcctattagttctgtccccctagagaatgctgactaatacactcccatatggaggggcaagggacagagcctttgtaaccctccaggattatgggatgcctaggaggggaggaggatttcccagcactaggtggcttcctacaggtgccttcttgccagaggcaggactttgctatgagctgttagcagccaggtctcccagcagctggggggacagagggcctcggtggtcctgcacagaggtctgagtggtatagcaccgacagcgaagctagtgaccaaagtggaaagacagagatatgaaaatctttcaactaattaagatttaaaactcagattgatgtgagaatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacagttcacacctgtaatcccagggtggccaaggcaggaagattgcttgagcccagaagttcaaggctgcagtgagctatgatcatgccactgcactccagcctgggtagcaaagcaagaaaaaaaaaaaaagcaagaaaggaagggagggatggaggaaggaaggaagggagggagggaaagagagagagaaagaggaaagaaagaaaaagaaagaagaagaaagaaagaagaaagagaaagagagaaagaaagaaagaaagaaagaaaggaaggaaggaaggaaggaaggaaggaaggaaggaaggaagaaagaaagaaagaaagaaagaaagaaagaaagaaagaaagaaagaaagaaagaaagagacagacagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgatgggggtgatgctccctccaagataacaaagaaaacctggccaggcacggtggcccgcgtctgtaatcccagcattttggaaggctgaggcaggaggattgctagagcccaggagttcaagaccagcctgggcaacatagtgagacccccgtctcttaataaaataagaaaaaagaaaagaaaaccttccttttacatgaaggcatcataccttaaatgcacatcctatctgcccaggaggcccacctctagatttgtatcctactgatgaacacacaccaagatggacatactagcataaattgtggagaatgacagaaaatatcctgaatgtccaccatgagggaactgattaatttatacacatccatatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttgtgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttgtaggcatacaaactaaattaattagccatccctatagcttcaacatgcatttcaatttgcaagcaccctggcctccaagattgattgattggctgtaaattgagaacctcagcaatttcctttcacagggacagatgttgacattgttcctgtgatttttcacagatgtttgccttccagcatctttaaaatcgagttttctgtcaatttggaaatcccaaatttctcatatcaaatcgagatgtcaggaaaatcaaaaccgttatcacattttgaaagagtttatggatggcaaatgacactgggaagggagatgtttaaggagcagctgacgtctcttaaccctttctcatcacttcctgcctcagtttacctaagccagaaaaaggggaaatttgattcaatatacagacaagggctttagagtctgcgtagctgtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgtttttttccttttttttttcccctttccctcctccttcaccaatcctccaagcagcttttcttccttcttcacgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtggcaacaggcaggaatatgatctactcatacaaaccaaacctctgctgtttgtacatcttagctaataatgcccaacacgcagccaacatttactaagtcaggctcttgagagccacttcatctgcatgacgccacaaaatcctctcagttattatttctgttttagagatatggaaatgagcaccagaggtagatgtaacttgacaaatatctgggtggtagatctggaaatcaaagaaccctgaaccccaaccacagacacatgttcagttcaggctgggtctctacgctttgttatttttaacggggcattacgctccctggatggctatgacgctgcggttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgcgatgtgtccatattagaagagacaccagagatatctttctctgtctctcactcttgcttgatctctccctctctctctcgcactctctctcatgctggcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtccttcctccaaccaataatagatggcttgtcctttccatcgcccaccttgggcaaggcaaacaggacagtgaaggcaagcacatctcacagaccccagcattcatgtgctaatgaggctcactactagtattggaaagatgggaagtcaaacagaattatgtccttgcgaacatacaataacttggaaaattttattgaaagacattaagtttgcatacacacaaaaatgagtgaagagttttttgttccattgaataatttagaggacatgtaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatatgatcaccgcctgtattgattggggttttccagagaaacagaaccaatgtctaaacagagagagatttcacgcaattatggaggctaacaagtgctgtcatctgcagggcgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaaatagctgtgcacctgtatccctaagagttaacacataaaacctaccaacccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaatgcctgcccagctgcagccaaacgttccatagacaatgtctctgggccttttgtggcagaaaaaccaacataaggaaaagaaggccggagacgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctaccgaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaattagctgaacatggtggtggacacctgtaatcccagctacttgggaggctgaggcaggagaatcacttgaacccaagaggcagaggttgcggtgaaccaagactgcgccactgcactccagcctgggtgacagagcgagactctgtccaaaaaaaaaaaaaaaaaattctcagacaaccagcagtgatacaagagataaaaggcatctggctttacgctgcaaacaaaacggaaacaggaagtgagagagcagttggcctctaagaagcatccatttattttaccctgccaggtgcctacaaggtgatggttttgcctcccaaatataatcaggggcccaatctctgcattcaaagaagtatatttcagcaacccataagtaatccaaaagcagttccccacacatcagctcaaacagtgttacagggcaggcattcttggtgccatcagatccaatgtcccatgttttaaccaacaattgaaaagccctcttttttttttgagacagggtctcactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaatgtgctgatcctataacccatctactcttctaaccaatcacaattgtgccctaattataataaaaaggagaaatgaaatgatgaggatttctaatgaaataatatatagagaaatgatttgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccgaggtgggccgatcacaagatcaagagagcaagaccatcctggccaacagggtgaaactccgtctctactaaaaatacaaaaattagctggacgtggtagtacccgcctgtagtcccacctactcgggaggctgaggcaggagaatcgctggaaccggggaggcagaggttgcagtgagccgagatggcaccactgcactccagcctgggtgacagagtgagactctgtttcaaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacacacacacaaacacacacacacacaaacacacacacacaaacacacacacacacacaaacacacagacacacacacaaacacacacacacacaaacacacacacacacacaaacacacacacacgggacaattcagtccccagtgagaacctctgtaataaaaggtccaattcctaacctgcaataatattctttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgtgttagccaggatggtctccatctactgacctcgtgatctgcccgcctcagcctccaaagtgctgggattacaggcgtgagccaccacgactggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtatctgctactgtgataattaaggtaattatttagaccaggaatctgcaaaatacagcctgaaggccaaatccgagctgcctgttttcctatggcctgaaagctaagaaagaatggttcttacattttatattattattattattattattattattattattattattattattattattttgagatggagtctcgctctgtcgcccaggctggagtgcagtggcaccatctcagctcactgcaacatctgcctgccaggctcaagcgattctactgcctcagcctcctgagtagttggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgcactacaatggcagggttgcatggttgcaagagagcacatggcccccaaagcctcagataatccactatctgggcctttacagtaaggttgtcagcccctggcttaggcactaaacaggtgctttcaagcacctactatatgccagacactaaagtaatagagaggggagacaatcaacaagaagcattctttctcaaaagttttaggctgggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagtaaattaattaattaattaattaaattaaaagcatgttattcagaatcacatagacttgggctcagctcttcagccataagcatgtttcttttctctttttctttttttttttttttttgttgagacagagccttgctctgtcacccaggttggagtgcagtggcacgatcttggctgactgcaacctccacctcatgaggtcaagcgattctcctacctcagcttcctgagtagctgggattacaggcacgtgccacgatgatcggctaatatttgtttttctttctttttttttttttttttgagacggagtttcgctctttttgcccaggctggagtgcaatggtgcaatctcagctcactgcaacctcctgccttccgggttcaagcgattctcctgtctcagcttcccgagtaactgggattacaggcgcatgccaccacacctggcctaatgtttgtatttttagtagagacagggtttcaccatgttggccaggctggtctcgaatgctgaacctcatgatccgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgttacccccttcaaaaataataataataatatgaaagttgggaagtggaaaaccatcctctggagttttcaaaaactaattccgttgtaatcatagaagactgaaggcaggattcatgtcacatttctcttcctcctgggcagatgaatctacaatttgtatttgattttaaatgtgattctcctgcatcttcagtgggtttgattgatagagcacatggggccactcagtaaaatgatacagtggagatcaaagccggagagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcataaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccttggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacgattgcttgtcaaaaaaagagcctctcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccgctataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgaagggaggttggatgaatgaataaaggagtgagaaagttaattgcttcccttctctgggctgctgtatcaatcaaggttgtggcaggaaatacatagtaaactcaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcaagtgctggaaacttaatccctgatgcaaccgtgttgagaggtgaggccttcaagaggtgtttggatcatggggacatcatctttctgaatggattaatgcctttatcatgggagcgggctggttttcacaggagcaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgcttataagagaaaccattctccaaagcccagagtaattatagagcccagaagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccctttccttccacctggaggttagcaggaactttcaaaggtttagtgtcatccatatcccattgtcttcttcatgcacagaaaagagaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgacatatgcatgtaaagtgcttgatataatgcctgacatggaaaaaacactcaataaacgttagtcatcagtatttatatcatcattccttttaatacacgccatcgactgggtgcagtggctcatgcctgttatcccagcactttgggaagcagaggcgagaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggtgcggtggcttactcctgtaatcccaacactttgggaggccaaggtgggtggatcatgaggtcaggacttcgagaccagcctggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgctctccagcctgggcgacagagcaagactccatctcaaaaaaaaaaaaaaaaagaatgaataagacctactatttgctagcacaatggggtgactataatcaaaaacaatttaatcgtacattttagaataactaaaacagaataattagattgtaacacaaaggaaaacgcttgagatgatggataccccatttggcctgatgtgataattacacattgcatgcctacaatatctcacgtaacccataaatatatacacctacgatgtagtcacaaaaactaaaactaaatataaaacaacaagcatttatcatctaattgtctggatttggaacccacaagccaactcagctaagtgctctggcttagggtctcccatgaggctgcaggtaagatgtcagccaggactgcagtcatctgagcgtttctggggctgaagactaggcttccaggctcactgtgtggttgtctctatcccttactggctcttagacagaaacctcaattcctcaccacgtgggcctctccgtaaagtgccttagtgtcctcaaaacatggcagctggcttcctccaaagcgactgatccaagaaagagagagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgagtctcgctctcgctgcccaggctgaagtgcaatggcgcgatctcagctcactgcaacctccgcctcccgggttccgggaattctcctgcctcagcctcagcagagttccccaagggtgcctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttttttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcagactcttaacaaactatccctgagaggaaaagagaatgaattcatactctgtggagtgtagcccaaaataacctctgcaagggtgaaattttctttgaagtcttattttaccttaggtatttgtgaactctgcgttctattttgtgccacatgtgttttaagttactattactctgctaaagtttattcatcctccaggaagatgatgatgtttgtactgtagttttttatgtcccagggatacagcagggttccccaagggtacctgttggcctagtttgagactcttggctctgttagtgggagtctcaaactatgctccaggctgctgattgttctgagggatttctctttctttctaacactaagaaataggaaatacagttttcagtttaaaaataacataattaaaaagtgtagaaaagtctctcttggccgggcacggtggctcacgcctgtaatcccagcactttggaaggccgaggcgggcggatcacgaggtcaggagttcgagaccagcctcaccaacatggcaaaatcccatctctactaaaaatacaaaaattagctgggtgtggaggcaggcagctgtaatcccagctactcgggaggctgaggcaggagaatcgcttgaacccaggaggtggaggttgcagtgagctgagaatgcactactgcactccagcctgggtgacagagtgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgttttggttgttgctgttgttgttttttcagagagagtctcactctgttgctcaggctggagtgcagtggtgggatcatagctcactgcagccttgaactcctgggctcaagcgatcctcctgcttcagcctccccagtagctgtggctacaggtgcacaccagcacgccttgctaattcaaaaaaaaaaaaaaaagaaaaagaaaagaattgtagagatggggtctcgctatattacccaggctggtctcaaacttctgacctcaagtgatcctcctgccttggcctcccaaagtggcaggattacaggcataatccagccattgtccctggcctggcttttttttttttttttttttttaatgtagctcacgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgactgtgagtaagttcttaccctctctgagcctgtttcttcacttggaaaataaaagtatacatatatatagctgttagccagaactcagcctagggtaacctttcaataaatattagcatcatcaaggaaatcacttgacaaattaattttcattaagcaatgagggtctataacagtgatgacttctgaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagagcacagctactggaatcagaggcagaggagctcctcttgcgtttcgttgctggtttcccttggttttgtaaaaataaataaataataaaatagggatacacccttcagacaacaggtaacttcctaagctaagatgaacaggaggaaatttaaatgtctttctccggttcaaatcccctaccctctcccatctgcctaccctgggctccaacactcgggagaaagaccataagtcgttcagatgatgctttggagctggacaatcaatcgtgatcaaaaacaggggcatgggagcccggctaacgtggaaggatgggagaaaatcaggctgaattagagaagggtacattgtggagtgtgttttacaacgccattagttctaagcacataaggatttcaaatcaaggagcatccacacacacacaaactcttggattacttaagagataaggcggatccaaaattagcatatagatcagaggcatgcagttgagtgctgctaaagtgggctataaatgcttgggggaaaataaactagttgtttttctgaagaaagctttacaacgttccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctctctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttattgcagcctgatatggttcggatttgtgtccccgcccaaatctcgtgttgaatcgtaatccccagtgttggaggaggggcctgggggaaggggattggatcacggggacagacttcccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttccccagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcgctattgtgtcaccttggggcaagtcacccaacttctccaaatgtttgtttcccaccaggaagatggaaatgacagtacctctccttcctaccccgcaagcctatcaggaggatcgaaagggacatggcaagcaaatactttctaaactgtaaagtgctgtgcaaacgcaagacagcattactctctttttatggagttatttatactctacctggttacagcagaggatttatggtagatgtcagtaaggctctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcatactaagtgcagtacccagcatgatgtctagcattgaaacatacagtgtatacaccagcacctccaccaaacccatatccagcatgcaaaacatacccttttcaagtcggaagcacatagatagattttttggagttcaaaaggtcttaatgcaaactggctccaattcctttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccgaaactaaaagctctttccttattgctatttctttaagtcctaacaattggtcaggcacaggggcttagctgcgccattctagttaatggtcggttacaaatttccaccataaactcatcttccttctagcaacttaaatctcaggcactgggatgtaataaggagagaaagctcttaggcccagggcaatctctctcaatcccaatctccctttcccccatccctatcccaccacaataactgttagtaagagcttttggttgcatgcccagaaatctaactctggctaaattaatcaagaaacgaatatactggtttatccagctgaggtcatttacggaaagggagtgctaaggtttgaatgtgtctcctccaaaattcatgttgaaacttaatcctcattgcagtggtattaagaggtgaggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagcaaggaacagagccccttaccagacacaaaatgtgcctgtgccttgaccctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctcgctctctctctctctctctctctctctctctctctctctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagatcctgatgtttgaccagatatgtgccacttaccaaccatagcagacactggcaatggccacccatgtcccttggaccctccccatcccatacaagctgaaggcatccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacaatttgaggtgtgttccatgccatcaaccaaagcccatcaaaaggaccaagccctggctccccatagaagtaacttactcattaccttgctttattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatgggtagacggaggaaagcaggttgcactccagatgtgcatggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacagctctttctggatctcaagcctgctggttttcagactggaactacaccactgggtctcctgggtctccagcttactgactcatcctgcagatcttaggacttgtcagcctccataattgcatacacacacacacacacatatatataaaagtgcatatagatacatatatgtatgtgaatgtatgtatataaaagtgcatatagatacatatatgtatgtgtatatatatatacacacacatacacacacatatatgtgtgtgtacatatacatgtgtgtatatatacacacatgtatatgtgtgtatatatacacacatgtatatgtgtgtatacacacacacacacacacacacacacacacacacacacatatatatatatatatatatatgaagaccatagagaagtctctaagccaaagctggggacaggggaatcctgtgtctcctggggagaggtctgctttagtgtccctgccatgctcagtcattacccaggagcacctcatggaaggaagcatatggattccccatatgcttatatatgtgtgtgtgtgtgtgtgtgtgtgtgtatatgtatatgcatatgtgtgtgtgtatgtgtgtgtgctattctattggttctacttctctaaagaaacctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagaccacctaaacaaaagggtattaaccaattaaaataacctaaacccacacttgtccaaattgctgagcaagtgggatggaatggaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaactttaatgcacacatgggcagacaagtaacacaaatgagtgaagagtacagattagggcaactgggtctggtggagactgtggcaaactagagagcacacaccctatctaaggaggcagcgaggacttaattttgcaagatttgtggaatggactcccaatgttgccaaactgccactattttttaaagagaagcaggaaatccaggggtttttaaagatgtaaaatacacagtttgttgaatgctggcaactgatttttttttttttttttgagacaagagtctcactctgttgcccaggctggagtgcagtggcatgatcgcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggagttacaggtgtgagccacagcacccagccctgattttttttaatgtaaatactgtatgaacccagacaaatgttctgccaggccagtgctgcatggctcaccatgtggtggccctgagaatgggcctcatcgacctccctctactgggagtgtaattaaccagggccccagctgctgcgctggggaatccatatgcttccttccatgaggtgctcctggctaatgactgagcatggcagggacactaaagcagacccctccccaggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaaacctgtatgggagtttgtttctcagaactgggctgacacaccatcttgcaaactctgctttcggcattcagctcacacttacttacaccctccaaactccaactatttagggctaattccattccagctcccaccccttgaatcccttcccccctccccccacttcctcctcccattctgctttcctggaaacagcatttccacttacttttgaacaatggtccttccttcactgttcattcatggagtttggatagcaccatcttctaaagctagagctgagcacatgatcaggactgactaatcaccctcttctacttccttagccacaataattcgttcagagatgggcacctgactcttacaatgcaatgagagtcagcttcttatgccagtgcttttggcaaaggtaggttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaatccagcacataagtctaggagcattgaacaagggtcagattgcatggattcagattccagctccattactaacaggctgtgtgaccttggacaactcaattgacctctctggccctcagtttccttattagtaagacggaaactccaatcatatctattgcacgggatagttgtagaaattaatagatacataagtgcttagtgcaacatgtggcactcaaaatatgtgtggtatgattgttattgacacaatggttgacccatgaatgattgtgatgccaaccccctcacagttggaaatccacctataacttttgactcccccaaaacgtagctactaatagcctattgttgaccagaagtcttaccaataacacaaacaatatacacatatgttgtattttatatgattatacactgtatttttacaataaaataagctagagaaaacaatatatgattaagaaaatcataaggaagagaaaatgtatttattattcattaagtggaagtggatcatcataaatgtcttcatcctcattgtcttcacattgaggagactgaggaagaggaggaagaggaggaattggtttcgccgtctcagaggtggcaaaaacagaaaaaaatccatgtataagtggacccatgcggttcaaatccatgttgttcaagggccaactgtatttatattacaataaatgctgttaatgttgtcactgttgacccttctagtccattcccaacatcacttcctacgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacatcaagtatgaattactttaattgccccagaagaacgcactgttgaaatatttgacttgcccagaactaattgtctgtcaaaaagagattttgcagccaagctgatctcttcattggacatctaatttaactgaaaacctttttccctgcttgttttatgctttcttctcctgtttttgccaaattctggatgctgggcactgctttcggaaataatttatcttgttattttctattataaaagtaatacatgttcattatagaaaaactgaaaaaaaaaattccaaatgaagaaaaacagttgatcctagactcattgcccagaggaagactatgaacattccacatgaagaaaaacagtggatcctagactcattgcccagaggaggactatgaacattccacatgaagaaaaacagtggctcctagactcattgcccagaggaagactatgaacattccacatgaagaaaaacagttgatcctagactcattgcccagaggaggactatgaacattccaaatgaagaaaaacagtggctcctagactcattgcccagaggaagactatgaacattccacatgaagaaaaacagtggctcctagactcattgcccagaggaggactatgaacattccaaatgaagaaaaacagtggatcctagactcatcgcccagagaaagactatgaacattttagcacgtctccctcccaggtttcctagaatagatgtctgtacatagttaataaaaacatatattcaagttttgcagctttttgttccactttacattttaagttgaacgtttacacttcccattccaagatcttcagaaacatgtttagaaacagaagagtatcccaacaacagtctgtttaacctcttcccctaatgctgaactattgttgctttaagaatacattttctgtgtgtgtttcagatgtagtttccttaggaaagattctctatgctgtgcaacaattccccatgtgtctcttacatttctgcacatcttgtgtcagcttttgttctagaccgtctttataaggatgtttgtatagctaatagcattagaagatagggctagtatagtagaagacagatttatttgctgattaggattataataataatatctctggaccaggcgcagtggctcatgcctgtaatcccaccaatttgtgaggctgaggcaggcagatgacctgaggttgggagttcgagaccagcctggccaatatggtgaaactgctgtctctactacaaacacttaaaaaattagctgggtgtggtggtgggcgcctgtaatcccagctacttgggagacaggtgggagaattgcttgaacccaagaggcaggggttgcaatgagctaagatcattccactgcactccaacatgggtgtgacagagcaagactctacctcaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccatgtattactcatttctcacactgctaataaaaacatacccaaggctgggtgtggtgtctcacacctgtaatcctaacaccttgggaggccgaggtgggcagattgcctgagctcaggagtttgagaccagcctgggcaacatggtgaaacctcatctctactaaaatacaaaaaattagccaggtattgtggtgcacacctataatcctagctactcaggaggctgaggtgggagaatcgcttgaacccgggaggtggaggttgcagtgagccaagaatgcgccactgcactccagcctgggcgacagagtgagactctgtctcaaaaaaagaaaaaaaaaaggctaggcatggctgtaatctcagcactttgggatgctgaggtgggcagatcacctgaggtcaggagttcaagaccagcctgaccaacatggagaaaccccatctctactagatacacaaaattagctgggtgtggtggtacatggctgtaatcccagctactcaggaggctgaggcaggacaattgcttgaacctgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagcaaggggaagaatgagcaaaagaagaaaaagccccttataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatgagtcattgcctgaaatctcttttgtcatcaggaagggatagagctgcttgactcagatctcccaggtggccttagaccgtaatgtcttcctttcgtgcagagctcttaccatcctaagccactactcctacctaatattctataaaaagctttttctccctacccagtgtctccaatgagctgactttcttttctggattactcttttatgtaataaaaagtagacatgagggtcaaagggaaaaaggggaatttgtttaatttctaccaagtgccaggcatagtacaaagaacatttagataaggcagaaggcattaattatttttatctacccagaaccccctgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaaacccaccatggtaaaaaaatacatatataaaaataaaaaagatatgacagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaatgagatagcaatcatgtcctacataccccctttgagctcggtattcatttcttaaaactgcttgccattgccacaagtagctatcaattaatctaataatgccccactggatgctataacccacaccttatagcttaacaatgtatagccaatcactcgtcaatgttatttctgaaaaccagtgagaattcctgacaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactctgtctctctctctctctatatatatatgaatttgaagcccttcaaccatatggatcatatgttgaagtcctaaccccctagcacctcagactgtcattgtatttggagataggggctttaaataggtgattaagtttaaacctatttagctcatttagggtgagctctaatccaatcagactcgtgttcttataggaagaggagattaggacacacagagagacaccaggtatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacagtaatccatcaccacttatgacaggctctgccacatagtaggtgtgtgtgcacacaccacacacaatcatgtttagaatatgaaatccgtgaaccctactcccacactgataacagttcaggaacagttgatttttcctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagagtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacgttctctgagaggaagatacccaaagcttcaagctcacctcaagggaaaattgagctaggttcccatgctctccacttggatctcacgcacatgaacacacatacaaccttctcctcaatattcacaagaggcctctgttgtctgcttctccagagagtggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaatttttttttttgtagagatgggggtcttgccatgtcgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattatataagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgaaggccataaaggctccaagctagatggatattgggggagtgggttagcagagatgtcctaaaacaatgtattacactaatgggaagaacaaaaggtaagtctaatcacagatgtcttggttttcaagctagtcagacttcagataactgtcaaatcttcagccataaatcgaaagtggaggagaattaaagacccatccttgtttgcttacagaatttacttaatttagccactctatccttaattgatagcaacaggttttttcaaaatagccaaagtaatctatgctttgctacataatagcaaaagtaatagccaacatacatcaacacctactatgttatacccttgacaggttttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgggttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactcttgtctcaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatagcagcatggttatgagcacagactctggagcaagaggtcctaggttcaaatcccagttaccctgcttatcagctaaatgacttctcagtgccttggtttctccacccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaactacacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaagtggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttcttattttttttttttttttttttttttttttgcgatggagtctcactctatcacccaggctggagtgcagtggtgtgatcccgactcactgcaacctctgcctcctgaattcaagtgatgctcctacctcagcctctcaagtagctgggattacaggtgtgcgtcaccatgcccagctaatttttataattttagtagagatggggtttcaccatgttgaccaggctggtcttgaactcctgacctcaagtgatccccctgccccggcctcccaatcatggtgggattataggcttgagcccctgtgcctggcctagaaagctaacttcttaattgcaagctactttcatcaatataatgcatttgtctcactccttaaaggactcctgtcacagtgaattggcaaagaactggtcagacacaagaggcagtggagtattagtaaaatacacgtggatttggagtcagaccttcctaggtttaaatgctggttttatcgcatactagttgtatgccttcatcggggtttcccaagaatcagaccctgagacaagactccaagagtaagtcatctatgtgggaggtaaatgaaacatgacacaggaaatgaaataggtcagggaggcagccagtaaagggcatattataaaacaagttaccacttgggacaataactggagcttaaacttgctggaaaactctaggatacactgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtagttatccacttacaccaactctcatcagttcctggtggagggatgctcccagggcaggtgttgattcctccaagacttccaagccatcatacgggtgggcaaagacagtacaaccagaaaaagacctcagaaagagggccaggcatggtggctcatgcctgtaatcccagcactttgggaggccaagacaggtggatcacctgaggtcaggagttcgagacagcctggccagcatggcaaagccccacatctactaaaaaaaaaaaaatagctgggcatggtggtgcatgcctgtaattccagctactcaggaggctgaggcaggagaattgcttgaacctgggaggcggagattgctgcgagctgagatcacgccactgcacttcagcctgggcgacagagtgagactccatctcaaaaaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatattcatggagcacttagtatatacccggcaatcttcaggccacaggaaacagaatgttgagttaccatgacaaagtcactgtcacagagccagtggggaaagcagcctctaaacatgccacccagtaagtaacaaagatcatttcaggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaaccaggaaacagagtggagaggcaggcaggaatcagtgtctgcagtgcgtgctcagcatcataaagggtttgagtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggaaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcaccatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctagatgctatatgtgttatatataacatacatgttacaatatatgttagatatgtatgtcatacatatcataatatataattatacattgtatattatatattatactattacatataatatataattatacattgtatacttgtatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatgtattatattatatataatacatggtttatatgttatataacatatataacaaattatatattatataacatgttatataacaaattatatattatataatatgttatataatataacaagttatgtaatatacaatatatgttattaaaatagatattacataatatattaaataatatatgttttatatattatattatatatgttttttatatattatataatatatatgttttatatatattatttttgtttttttttgttttttgggggttttcttgagacagagtcttgctctattgtccaggctgcagtgcagtggtatgatcttggctcactgcaacctccgtctcccgggttcaagcaattctcctgtctcagcctcccaagtagctgggactacaggtgcccacaaccaggcctggctcatttttgtattttctttagaggcaaagtttcaccatgttggccggactggttctcaactcctgaccccaagtgccccgcccaccccatcctcctaaaatgccgggattacaggcatgagccactgcatccagcctatatatgttctttcatcatcaccacatcatctaattttacagatgagaacactgaggcttggggagatattaaatgtcttatccagattgcatgcatgtaagtgacataagcatgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgcataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttggggaaggtttctatcattagacctctcttttcccccaaccatccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaatttttttttttttgagacagtctggctctgtgtcccaggctggagtgcagtggtgcaatctcggcttactgcaacctccgcctcccaggttcaaacgattctcctacctcagcctcccaagaagctgggataacaggtgtgcgccaccacacctggctagtttttgtattttttagtagaaacagaatttcatcacgttggccagacttgaggtcaggtcttgaactcctgacatcaagtgatccacccgccttggcctcccaaagtgctgggattataggtgtgagccaccgtgcccggcctgaagatcacaattcttatctaactctgctattcattggctgggccaccttgggcatgtccattagctttctggttcttaggaccctcatgtctaataacaaggtctttcctacctgccccacagggctgttgggaggaccaaatgagatcaagaatgcaaaagctctctgtcaactgtgaaacactaccaggagtaaagattcacaaggcatgagttgccacaaggcagtatagcatggtggttaggaggttaagctcttaaaccagattatttggattccagtataaccccaggaaacttaactttgttttgtggtgttgttgttttgttggtgttgttgcttggtattttgtctaatttttagaaacagggtcttgctctgttgcccaggctggagtgcagtgggcatgatcatagttcactgcagccttgaactcctgggcttaagctatcctcctgcctcagcctgtggagtagctgggactacaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtagtggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgttgtgattagtgctcaaaagcataaagcataaatggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctttccaaaaacgaatttaacttgccttccaaataattttactcctaatttttagctcactttctccatgaatatcatcaccattcacccagttacccaaaccaagagcctgaacaacatctttgagtccttctccatcacaccctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaaatcacatggcttgggtagcttcatgagagattgggaaattagagggttttggttttgttgttgttgtttaaagcagagtctatgtcaccctaattaaaatcagtgtttcatcttttattcttcctcaaatattcagtgttaaagtcactaaagggcaccaaccaaagtaagcatcaacgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcaagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcatattatgggcatataggagaaggtccttattgcaagacacacacagtaaagtattgggaaacgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagatagaaagccatccacgtgaagagcaaggagacaaagttttcaggcagaaggaacatgtgagaagtagctgaacttgttttcagagttataaccctagcaatatggtggaaaataacaaataactagcaatatggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagcgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagtcgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagataagcatttgaaacatgctacaaatttgcctgtatcctacattaaatggaattttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttagaaggagtttcactcttgttgcccaggctggagtgcatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatgattgaagaagcaataacttaccccagtgccgccaaggcaagttgtctcaataatgtaacaaagctatacttaatggcaacagagcacgtttcactgatactacaccataaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccatgaccctgcttttgagacccctactctctctcccttccctattatctcttggtgaatattggggaatggctcacctgaactgccccacgatttcatgcctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggattgaaggaggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttccggccttcatctttctcctgtgctggatgcttcctgccctggaacattggactccaagttcttcagcttttggactcttggacttacaccagtggtttgccaggggctctcaagcctttggccacagaatgaaggctgcactgctggcttccctacttttgaggttttgggactcagactggtttccttgctcctcagcttgcagatggcctattgtgggacttcaccttgtgaccgtgtgagtcagtaccccttaataaactccccttcatatatacatctatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagagagacataaatattttttaaaaagaatcagaaacatatgccccaaaatgctaatatgattacatctgggtggttaatatttattttctgtttctattctctttgtgtttccccaaatttgcttgttgacagcacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaattagctaggtgtggtggcacgtgcctgtaatcccagctactcaggaggctgagacatgagaattgcttgaacctgagtggcagaggttgcagtgagccaagatcatgccactgcactccagcctgagcaacagagcgagactctgtctcgattaaacacacaaacacacacacacacacagttatcttgatggcagttcaggaacttgggagatgagggctgttctcctgaaaccctataagaaccctcaggtgggttatgccacccgttcactaatatcccatttacgggtgaagggaaaggtggaggagaccaaccaacccaccagcagtggcctcagtctcaaataaaacttagtccctgagttagaagccaacttaaccatggagaggaaagagttcatccgatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgtcttagcaaaattatgactgagacagtgaaagagatttaacttgatcaattccatctttcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatcagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggttacactctgtcgagaaggaacacagggagctgtggaaggcttccagaggaagtgcctgggctttgaagaatgagcaggcattaagtgggcaaaagagcatgtgcgagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaatataaggtggtgggatttcagttgaaaaggtgcccagggtcggcctcgggtcagtctatctttgggtctatcacaaacactatattaattgcccctattaatctttcatcatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaatagagtcacagtgacacggcaaccaggagtggcaagggagccacagacacacatgattagacacaacaatcatgttttcaaggcacagcccacttagagatcacagcaagatgctttatccaatctccgccggcaatcagagcttgaaaaaggagcattgtcgtcaatcaacttccctttgggcaaaaggcacaggcaaaggagaagatacttcacccaccttttaataaatgtgtcttgaggagagagttggcccacagagtacggtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgagaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaataggtgccacaaatgaaaatccttgcagagagtccaggcagataacataagtgaagaaagggaggaatgagaagcagtagggaatggtggggtctgtggtgaattggagtgcatgccccattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaacccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgacaggtctctttccttcacaggctgagacaactccaattcaactctgaatccccaatacaggacctgcccagggaacagggctcagacatttatgctgcgaaatactcagcttttggggctcagcgtccttttctgcaaaaagagttcccctcccaagaggaaatcccctaagcctaaggacaggaggtgatggaaagatggacggatgggcagatagatggatggaaaaaaaatggacagttggaaacagacaaacttggtggatgagcagaaataagcctcattctcgcctgacaatgggacagcctgggggaggggcgggacacaccaaggctcccagttgacccccagcaattggacaagagagtttataaaccagcatcggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcagaagatacggttgatcctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtctgagccaggagttcgaggctgcagtgagctacgatcatgacactacactccagcctgggagacgcagcaagaccctatttaaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacatggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccagcactccaggcctctacctgggccctttaatgccccttccccattcctcaagagcccactggggtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgtgttgctcacagttctggaggctgggatgtcccagatcaaggcacctgcagattcagtgcctggtgaggagggctcactctgcatcataggtggtaccttgttgccatgtccttatatggcaaaagaggcaaaggcgcttgctcaagccccttttataaaagggggcactaatcccattcatgaaggtggattcctcatgaattagtcacttcctaaggggcccctcttactactatcacattgggtattaagttccaacatatgaattcaaggggaacaatgacattcagaccatagcaccagacgtctatctggggaagcccccaaatatttgtcttttttttttttttttttttttggaggcaaggtctgcctctgtcattcaggctggagtgcaatggcacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcacctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacagctggagaggggctctcacagggtccatgggaagagaccaaggaggggcatggaggagaggggagggctgagaagaccagggtgaaatggatgaggagaaggaagcagatggcagggaccctcccatctcccacatgggcctccttaggtgctactggccttgtgcaaatttgcacactcacattcacacatttctgtctgcttctctccaatctttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaaattttggggaggaataaatggcatagcagatggggaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctcctttttttttttttttttttttttagagaccgggtctcattatgttgcccaggctggcctcccaaagtgctaggattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccactagaggagccatctcagaaatgaattctgcagccccctggtgagctccagctgatgccacgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcagctctgcaggaagctgtttttgcacaaggttcttccacatttctgggaacccaggagatgtctacttcagctacaatctctcctgctcgtcccctgtcccctcgggagggtctggctcagaacagatttcactgtgggacccaagccaacctgttagccactcctaccccaggacggttgaaacagtctttcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacgcagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcagccgctgcagtccagccagcctggatgacagagagagactgtctcaaaatacaaataaaataaaataaaaaaagaatgagactcttcttactgcaaaaactgacctctgcggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccatctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactataattttttttttttttgagacagagtctcgctctgtcgcccaggctggagtgcagtggcgctatctcagctcactgcaacctctgtctcctgggttcaagtgattctcctgcctcagcctcccgagtagctgagattacaggcaccaaccaccacgcctggctaatttttgtatttttagtagaaacgcggtttcaccgtgttggccagggtcgtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaacctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcctgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaaaaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttgacggagtctcgctctgtcactcaggctggagtacagtggtgcactctcggctcactgcaacctccgcctcccaggttcaagcaattctcctgcctcagcatcccaagtagctgggagtacaggcgcctgccaccacgcccggctaatttttgtatttttagtagagacagggtttcaccatattggccaggctggtctcaaactcctgaccttgtgatccgcccgcctcggcctcccaaagcgctgggattacaggcgtgagccaccacgcccagccctttttgttttttttttttttttgaaacagggtctcgctctgtcacccaggctggagtgcaatggtgcaatcttggctcactgcaacctccacctcccaggttcaagcaattctcctgcctcagcctctcgagtagctgggagtacaggcacgtgtcaccacgcccagctaatttttgcatttttagtagagatggggtttcaccatgttggccaggctggtcttgaactcctgacttcaggtgatccacccactttggcctcccaaagtgctgggattagagacatgagccaccgcgcctggcccaaatttcattttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattagactctccccagtttcaggggatgaatcttgagcagtctgatggagggctggcaaaccattgcctaaacccggcccaccacctgcttttgtatggctcaggagctggaaatggcttttacatttttaagtagttagaaaagatcaaaagtgtaataatatctcctaacacataaaaattaggtgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaaaccagaggttctcaaactcagtgtccatcagaaacccccggagggcacgtttaaacatagactatgggccgggcgcagtggctcacgcctgtaattctaacactttgggaggctgagagtttgagaccagagcattgtttaagccaagagtttgagaccagactggacaacatagcaagaccctgtctctacaaaaaataaaaaaattagctgggtgtgggggtgcacacctctagtcctggctacatgggaggctgaggcaggaggatcgctcgagcccaggagttggaggctgcaatgcgctatgatagtgtcactgtactcctgcctgggcaacagagaccccgattctagtaaataaataaataaaaacatagatcccacccccagagtttctgatttagtaggtctgaactggggtctgagaatttgcagttcttaaaattgcctagacatggcagatgctgctggcctggggatctcactttaagaagcactggtctaaggcaaccttggtaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcgaggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcatactgcttgttaagtgcagagataggattccaactcagaggcatctggctcaagaacccatgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagcgggactcaaagatccaggcctgctcggtgtggctgcggctcgggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacgctcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcacgcccttatattcccagctacttggaaggctgaggcagggaaatcacttgaacccgggaggcagaagttgcagtgagccatgatcatgccactgcactacagcctgggcgacagagcgagactctgtctcaaaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagcatcacttgaacctgggaggcagaggttgcagtgagccaagatcatgccactgcactccagcctgggggatagagtgagactctgtctcaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactatgggtatacagcaccacgcctcgctatttttttttttttttttttttttttttttttttttttagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggtatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagttggtcaggtctcgccagaaaagttcacgcaataacaaaccagtcgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcggaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcacctgcaggggcttcctgcctggaaagcctgttcctttgcccttcttctccagaggattcacgtacctcagcacatgttcgacgacaaagtcacagcactgcagggacacctcccctggagaggaacaggatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaatacttacaaaaggccaggcgtggtggctcacacctgtaatcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtgtagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttgaattatttatttatttgtgctttcaaactgttttcttaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatctgagaacagagtctgccaacccctcctgatgagagactgacccctcatagccactgcaggctggaagccataagcttaaaccacttcgataccatgaaagcaaaatgtatggttggcaaaaagcaaaaaaaaaaaaaaaaaaaaactggttactggcgagtgcagaaccacagtctgggtcgatgacaaattatccagcatgaatcttggtgtgacttaggcccctcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaattattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacctaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccattttggctcactgcaacctccacctcccgggtccaagagattctcctgcctcagcctcctgagtagctgggactacaggcatgcaccaccaccacacctggctaatttttgtatttttagtagagacggggtttcaccatgtgagcaaggctggtctcgatctcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttgagacagagtttcactcttattgcccaggctggagtgtgatagcacgagctcggctcactgcaacctctgcctcccgggttcaagcgattctcctgcctcaccctcccaagtagctgggattacaggcatgtgccaccatgcgtggctaattttatatttttagtagaaacagggtttctccgtgttggtcaggctggtctggaactcctggcttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaagtcagtgtgatgaaaacatgttctagataaaacagaaatgagactgggcatggtggctcatgcctggaatcccagcaccttgggaggccaaggaaggagaatcacttgaggccaggagtttgtgaccagcctgggcaacatagtgagaccgcagatctactaaaaatttaaaaattagctgggcatggtggtgcatgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaataaaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaggggatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagcctttttttttttttctttttttgagactcttgctctgtcgcccaggttggaatgcagtggcaaaatcttggctcactgcaatcttcgcctctcaggttcaagtgactctccttcctcagcctccctagtagctgggattacaggcatgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaatacctaggctcctctcaggctcatgcccttcccaggggtctgggaagccctgacctgcagcctgtcacctttgtttaccccccagcctccaggatattacgtgtgcaccggcgtgggatcctggaactggcaggaactgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaaataataataatataaagtgaccaggtgtgttgactcatgcctgtaatcccaccactttgggtcgaggcaggaggatcactggagcccaggagtttgaaacgagcctaggcaacagagtgaaaccctgtctctatattaaacacacacacacacacgcgtgcacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacgccattcacccatttccacaaagctatagttagttagcagagggcagaattcggccgcctctcccctagcttgtaggctgtgattgacacagaggtttttttgttgtcgttgctgttgtttgttcctttttcttttttttgagacagggtcttgctctgtcatcccggctggagcgcagtggtgcgatgtcagctcactgcaaactctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggacagcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgactaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggcgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcatagttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctcctcttctctgtgctcacgttctttcatgcttagtttcctcagactagaagggagagaaatgcacacacatgatccaccagcacgtgtgggattccctctgcccttctggcatctgaaggctgtgattcaaagatcccccctgcaaccttcccacaaatgaaccaactgattctcacaactgaagggagaatggacacctcccattgagggataaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcaattcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaaaccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacactgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaagttgcagtgagccaagatcatgccaccgcactctagcctgggtgacagagtgagactccgtctcaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaattaaaaaaaaaaaaaaaaaggctgggtgctgggtgtggtggctcacgcctctaatcccagcactttgggaggctgaggcgggtggattacctgaggtcagaagttcgagatcagcctggacaacatggtgaaaccccatatctagtaaaaatacaaaaattagctgggcatggtggtgggcacctgtaatcccagctacttgggaggctgaggcaggagaattgcttgaacccaaaaggcagtgagttgagattgtgccattgaactgcagcctgggcaacaagagcaaagccccatctcaggaaaaaaaaaaaaaaaaaaaaaaaaaaaaagagaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagagccataccttcctgtctacggcggttggacctcctggctctctgctgtacatccgtggatccatcatgtccattttgagatgggaagatagtcttcaggaaagacacctaggaaataataatataagaatgacggctgggcacggtggctcatgcgtataatcccagtactttgggaggccgaggcaggtggatcacggggtcaggagttgaagaccagcctggccaagatggtgaaaccccgtctctactaaaaatacaaaaattagccgggcatggcagtgggcgcctgtaatccgagctactcgggaggctgaggcagagaaccgtttgaagctgggaggcggagtttgcagtgagccgagatcacaccactgcactccagcctgagcgacagaatgagactctgtcacacacacacacacacacacacacacacacacacacacaaagaatgacatgaggctggcagggtggctcactcctgtaatcccagtactttgggaggccgaggcaggcggataacctgaggtcgggagtttgagaccagcctcaccaacatggagaaacgctgtctctgctaaaaattcaaaattagccaggcatggtggtgcatgcctgtaatcccagctagtcgcgaggctgaggcaggagaatcacttgaatccagcaggaaaaggttgtggtgagctgagattgtgccattgcactccaacctgggcaacaaaattcaaactctgtctcaaaaaaaaaaaaaaaaaataggccaggtgctgtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatggcacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacaggtgtgagccactgcacctggccagtagttatcttttctttagttatttacttgttttttaaattgatgtataatattggatgcatttattatatatcacatggtaaaagaatccctctaaataatacttctctcttggattatatgaatctttgtcatttaaagctcagcataagtaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaacctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacatggtgaaacccagtctctactaaaaatacaaaaagtagccaggcgtggtggtctactaaaaatacaaacattagccaggcgtggtaatctgagctactcaggaggctgaggcaggacaattgcttgaaccccggaagcggaggttgcagtgagccgagatcttgccactgcactccagcctgggcaacagagtgagactctgtctaaaaaacaaacaaacaaaaaaaagtcatcaaaccagatgacacaaatcaaatgacatttcactttgttttggtccgttttgtctgttggagacaagagtgcaacagcgccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggccggatctgagttggggagggggaggggagggggaggggagggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaaggccaggtcctctctggaaccttcacaaacctgacttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttgtacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaactgagtgatgatgtccttatctatgtcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggccgcatcatgtgtgatgggtggggagctccaagcaggcgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaaacaagcaaaacaaaaacaaaacaggggctgggggtggtggctcacgcctgtaatcccagcactttgggaggccgaggtgggcagatcacaaggtcaggagttccagaccagcctggccaatatggtgaaaccctgtctctaataaaatacaaaaattagccgggtgtggtggtgggcacctgtagtcccacctacttgggaggctgaggcaggagaacagtttgaacccgggaggcagagtctgcagtgagccgagattacaccactgcactccagcctagacgacagagcgagactctgtctcaaaaacagcaacaactacaaacaaacaaaaaacaggattaacaaaactatggaattcaattctatttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctactgcccggcaggtgtggggctcaggctcccagccacctgcaggacgacggcagtggtcagcgggcggcagctcagacctgctcaggacagggatgagaagccacctcctcagcagacaggacagagcccggtgccatctaacagaatgtcctagaatgctggatatatgggacatctgcaccgtccgtgatggcagcccctcgcgacatgtgccactgaacacttgacagcagactggtgcagctaaggaacagagttttgaatttcattttttttttttttttaagatggagtctcgctctgtcacccaggcaggagtgcactggcgcaatctcagctcactgcaacctccacctcccgcgttcaggcgattgtcctggctcagcctcctgagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacgcccggccatcgttccattttaattaactttaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcccaagcttttctttgtgggattttttttttcttttttttggagatggagtcttgctccattgcccaggatggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacagggtttcattgtgttggccaggctggtctcgaactcctgacctcaactgatctgcccgcctcggcctcccaaagtgttgggattacaggcgtgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggtggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcagccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggctcgcagggcgccccaatgcgggggcagaggggcagagcttggcagggtccgcacagacctttgttgtcgtgccacactcggatcttccacacgctacccaggctgtgcggggtggcgatccggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgcggttactgcaatttgtccaataaacagcaggacctcaaggacatgattaagttacacggaaagaactgtaacttgtgacatgcaaacatggctgcacacgcctcagtccacaccacaaccagtgacccgcgctgcacacctgtccacgcctcagtcacgccacaaccagtgacccgcaccacacacccgtccctcagttcatgcacagactgcgaagcgtgaagctgtgtcacctcctctcccagtgacagacccaggtgacagtattttttttctttttttttttgagatggagtcttgctgtgtcacccaggctggagtgcagtggcgcaatctcagctcactgcaagctccgcctcccgggctcacgccattctcctgcctcagtctcccgaggagctgggactacaggtgcctgccaccacgccgggctaatttttttgtattttttagtagagacagggtttcaccgttagccaggatggtctcggtctcctgaccccgtgatttgcctgcctcggcctcccaaagtgctcggattacaggtgtgagccaccacgcccggccgacagtttttaaaagtaggtaatcaaaagaactgggaaatgaagatgaaagcaacacggaaataaaaaatgggaacacagccaggtgtggtggctcacacctgtcatcccagcactctggcaggccgaggcaggcggatcacctgaggtcaggagttcgcctggctgacatggtgaaaaattaactgggtgtggtggcgtgcacctgtactcccagctactcaggagaatcgcttaaggggaatcgcttaaacccaggagctggaagttgctgtgagccaagatcacgccattgcactccagcctgggcaacagagtgagactccgtctccaaaaaaagaaaaacgaaaacaaaaagggaatgccagaagggcaattccaataaaggaaaatggaggtattgaagaaacagccacggggagggtgctggcacctccgtctgagagacgagctatgcagtcaggatcgcgggtggatgcatggtctcccacagtggtagcgatgctcatgtcacttgtggggccacgctactgtgcagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgtcggctcctgtgaagacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcatgaagaggctggcgccgaaggcggtgaggtggcgggtgaggcagacggcctggcggggcgaggtctcctccaggggcagcagcccctctgtccgccacaccacatcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccacgggcctgaaaggccataggagcctctgcaccagagctggcacctgcttctccgtggcccccagctcctctccggccaggcccccaacagcccatgaaacagcaaatttcaccagagacacccatggaagccctacgagaaacgccttccccccaagaacaaggccagggggccgcgtgtgccccacccgctgcacacaccgtccagcagcgtatagttgagctgcagatgcagcacggccacagggctgctgctgtccagggtgaccacagcaccgacggaggcctggggctggaccacaacggagttggcggagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagagaaagggattggagtccaccagaaagacgagctgcaccacgtcactgaggttggcgggggccctgctgaaagcctaggggatggagaggtggcagccaggccctggggcgccgccatagcacagcaggctccgcgggtccgagcgcttgccctgggccatgatctcctcgcccgccagcgtcacgggctcctcgttgagcacgcgggagcgcgtgaggatgcgcatgagggcagaggtcaggttgtaggcctgggacgccaccatccgcaatggtgactcggctcccagctctgagcgctgcggtgcccgcacgtctgagctggccaggtggatgaggtctcctgcagacaggcgtgaggtcagtgcagagacagggaggcagagggagggtgggggcaggcaaaaagggggagccggagggtgggggctgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggtgaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaattgggggagggggatgaggatgggaattgggggagcgggatgaggatgggaattgggggagcgggatgaggatgggaattgggggagggggatgaggatgggaattggggggaggggagggggacgaagatgggatggggcaaaggcgaggcggttgtggggaggagggaggcagaggaaagggcggcatggggcggacgggccacgtggggcgggcgggtggcgtggggcacgggccgcggcacctgtgatgttgaggatgctgtctccgatggcggtgggcgtcacggtgcccgcggtggtctctgcctgcaggatgcgcatcatggcctccagcttgtgcagcgtctgcttcaggcacgagcggcatacgagctccctgctgggcccctgtgtggagccagcagtgtccagccccgctcctggccccactccttgcacacgccctcctctctacacgggtcctcacctggctcccacccccagccctgcagctggagagcccacttgactggacccccacagcctcctcactaagcattttttgtggctctgcatgacccagggcctccacctggggaacacgtgatgcagcccaccgaccacacaaggcacctcttcacatgagagaaggaggagggcagaagggagagaggagagggaagtggagaaaaggggggagaggagagggaaggagagagaagggggagaggagaggggaggggagagaaggggggagaggagggagggggaggaggggaggaaggaggaggggaggggtgaggggatggaggggctgggggaggagtggaggggctcagcgggatgaggtgaggggaaggtctaggggaggggaggaggggaagggctaggggaggggaggggctgggggaggaggcaggggctaggggaggggggagggactaggggagggaagggggaggggaggggttaggggagggaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaatggctgaggctactgaagcaggtcagagaccgaggaacgccatggcaggaaggagcccaggctggaggctcagctcctcggccaagctgcccgtctgccctggggggctgaacccagtaccctggcaggcatgcggggcggggagagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagtaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccacggcatcacgggagggctccgtgacctcacagagtcgggggatcccgctgctccccctacgcaggcctgcactcacccatgcattcgaagtgcaccttggtggtgagagcgtgcacagcgcccagtgggaagaggcggcaagagccccccagcggcgggcggttgggggacagggggatggaggcgcagccctcctccttgccagagcggcccagcaccgtcagcgtgaaggtgtatccctcgccgtcccgcagcacgccccgccgcagcaccagtcacatgcctgcgctgcccgtggatgtggtggtctcatccagcaccagcgtcttgttgctgaacgtacgtgcagcccaccgctgcaggcagaagggatggtgagggggcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggccagctgaggaaagcagggactggggaacagacacccactctggggtaccagcaggccccagtcagggaggcgcacacgctcacagagggcagggaggcgcacacgctcacaggcacctgctgcgtccggttctcgaaggcattagatgccagcaaggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggtggggggcagttcagggggcccagcttccctgtccactcctcccacgcctggcccctccctcaccccagtaggggcctaagccatcagcccaggtgaggtcacagtgagggctgttggggaggaagcggggcagcttgactgggggactgggggggccccgtgctcagagcctgaaaggcagtggccccctcaccccctcatccctcacctggggcagcgtaggtgtgggtgacattgtgctccaccagcacctgggccaccgaggggtctggaaccgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtggcggggcagggggtgcttgggacccagccgaggctccactctgcagtcacgccccgggcctccattcagggcccacccggctgtgctgaggcctctcccggctcccgtgcagcctcagggctcctgtgcacccagtacctcccaacagacagggaaaccgaggctcagaaaagcaaccccctgatgtggggtccctcggctgaggctggagccgggacaagagcctggtgcccggacaagagcctggtgcccaccccaaaccggcccctgagtcactcacaggaaggccacctccacggccgagtccaccagcacgcccgccgtcagtgccagcgtggcattgggggacagcacggctggcactgtagagacccgcaggccctgcatcctgttcatccgctccacggtgatgttgtagttcacggtgacgttgctcacgtggttggaggccgtcagctgcagggacaggcatcagtgggcccaggtggcaggtgagaggcctgccctgcttggcgtccctccctccactcaccacagccatggcagcgtcctcgggcagcatgaagcagagcagaaggcagaggtgaaggtggagcccgcccccgccccgccccatcccctcccctccccactcccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcgggctggagagtcccacgcggggcacagaggagaggaggtgcccggggctctgcatgccatgagagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagatggaacagccctgtcccccatgtacccagcatggtggcactgcgggcagcccgcagtttcccatcaggggttcggactccacctcaaaagccacttgctttagccaggcgagaacacagcagagggcgtgagagactcacggggactcgtgtgaggtcagggagcggagttttaaattcatttcgtgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcaagccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgggcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcaggagggcgccagggccagcgtcgtgctgcaagccaacgaggtcaccagggagcatgaggacatcctggctgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgcctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggccctgacgtgcagccattggcgcaggcctgggggtggcaggaggcgtccagcggcaagcagatgttggctccagggcaccagcgtccccctggcatgcacgcggggaccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcgcaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaaggcctgggggtaatgtgagtaaacgctttcctctctgcactctggattttcccaaccatcttcactgggcacaagcaacattaaggcccccaagttttttggcgagacccacagtgggcagggcaggcgaggcctccaggggcaggcaggagggcaggttatagaacgtggggggccgactacctccacgggctcgtgcggggctgagaggccgtcctgccgtgccagaggcatcaggggtccctacaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggcgctgggcccacctccaccccctgcacagtcgagaagccgatccacatgtctaggctcctgggggcgggtgtgggatggcagggggctcagggcactcctccatcctcccaccctcacagcagcccgctgggagccccgtcactgtccccctttccagatggggaaactgaggctcagagcccggagagcagggcccaccagcccaggctcacagcagcacccacccacggggcctgtgggcaccggcagggatccccgtgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtggggcaggcacctggtgacccgggagaccaggaagcgctgcacggcgggactgtccaccattgccagggtggccccggcccaggcccgacactgctcctgcgcctgcagccaggccgccttctccaccaccaggcggtagcagtgcccattgccagagaagatctccgtgtccgaggggcagagcgggtgcaccgctggagaccagtgggaacgagggtgtcaacggtcagtgtgggcccaagacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggtccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtctacagcccccacacagactcgaggggcccccatctcctgttctgaacccaacagggtggtcccactgtgggaccacaaccaggtatgactgtgtgagaagcaggctcactaccaggctaccagggagcacagcggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccggtctcgaaagaaaagaaagagaaagcaagaaaagaaagatggctgggcacggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggagaatcactggagcccaggagtttgaaacgagcctaggcaacagagtgagaccctgtctctatattaaacacacacacacacgcgcgtgcacacacacacacacacacatacaaaggcagccagactatgcactaggaactgccctgggaatccctttgtgttctcacaacaatcccatttcacatgaagaaacctaggcacagaaatattcagtaacgtgtccaggtgtggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacaccattcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgttctgtcatcccggctggagcgcagtggtgcgatgtcagctcactgcaaactctgcctccaagatgcaaatgattctcgtgcctcagcctcccaagtagctagaattacaggtgtgcactaccacgcccagctgatttttgtagagatggggttagtagagatttgtttaatagagacggggtttcaccatggtctctactaaaccctgtctctactaaaaatacaaaaattacccaggcgtggtggcacatgcctgtagtcgcagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaatcttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgaggtaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcaagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcacgtgtgggattccctctgcccttctggcatctgaaggctgattcaaagatcccccctgcaaccttcccacaaatgaaccaactgattctcacaaccgaaggaagaatggacacctcccattgagggacaaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaatcacttcaaagagaaagttaatgaacttgtttctgaccacagggcatccttcagcacatgctgtctggagtggcctcaaacaaggtgtgtgtggtgaggtgctgacaatgcaatgggagcagggtcctgtccccacgctaaagaagctcacagtttaatgcaaatgagaagccagtgaggacagcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatttggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgagttgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaattggccgaatgtggtggcacacacctgtaatccaagctactcgggaagccaaggcagaattgcttcaaactgggaggcagaggttgcagtgagccaagattgcaccatagcactccagcctgggcgacagagcgagactctatctcaaaattaaaaaaaaaaaaaaaaagcctgggtgtggtggctcacacctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccatttcaggaaaaaaaaaaaaaaagagagagagaaaggaaaaccaatgccagtactagcaactcctcttcccctgaaaaaatgacaaacaagaatgtaggaagggaaaggaattatacagcttaaactaatgaagcagaaaggacaagctcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggtggaggttgcagtgagccgagatcacaccactgcactccagcctgagtgacagaatgagactctgtcacacacacacacacacacacacacacacacaacacaacacacaagaatgacatgaggctggcatggtggctcactcctgtaatcccagcactttgggaggccgaggcaggcggataacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaaaaaaatataggccaggtgcggtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatgccacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacatgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaagctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacacggtgaaacccagtctctactaaaaatacaaaaattagccaggcgttgtaatctgagctgctcaggaggctgaggcaggaccattgcttgaaccccggaagcggaggttgcagtgagccgagatcttgccactgcactccagcctgggcgacagaatgagactctgtcttaaaaaaaaaaaaaaaaaaaaaaaaaagtcatcaaaccagatgacacaaatgaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggcccgatctgagttggggagggggaggggagggggaggggagggggaggggaaggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccttctcagtcccccacgctcctcccaaggccaggtcctctctggaaccttcacaaacctgatttctggtcctccccaaccagctccctgtccctgcttctgggtgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaacaaaaaacagggttaacaaaactatggaattcaattctatttatatgctgcagccatgttccagccctagatttggctgggcatggtggctcacgtctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacctgggaggcggaggttgcagtgagccgagatcgtaccattgcactccagcctgggtgacagaatggaatgagactctgtctcaaaaaaaaaaaaaaaaaaaagaagaagccctagatttcggttgtgttggttgtaaaaggagagacccagtaagtgggggtcatgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccaggtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcatctgtccagcaaaggcctgctgagaggtgcacagggtcttgagtccaagctgcgccaaggcggcaggacccccagtagagccctcacctcagcgtggaggcctgagaacgtgaggaaggagctgtccagcacggatgagtccaggcagctgtcgacgtccagcacctgctgcccggcaggtgtggggctcgggctcccagccacctgcaggacaagggcagtggtcagcgggcggcagctcagacctgctcaggacagggatgagaagccacctcctcagcagacaggacagagcccggtgccatctgacagaatgtcctagaatgctagatatatgggacatctgcaccgtccgtgatggcagcccctcgcgacatgtgccactgaacacttgacagcagactggtgcagctaaggaacagagttttaaatttcattttttttttttttagatggagtctcgctctgtcacccaggctggagtgcactggcgcaatctcagctcactgcaacctccacctcccgcgttcaggcgattgtccgtcctggctcagcctctttagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgggcttttctttgtgggattttttttttttttttttttggagacggagtcttgctccgttgcccaggatggagtgcagtggcgcaatctcggctcactgcaagctccgcctcctgggttcatgccattctcctgcctcagcctctcgagtagctgggactacaggcgcccgccaccatgcccagctgtttttgtatttgtagtagagatggggtttcattgtgttggccaggctggtctcgaactcctgacctcaactgatctgcccgcctcggcctcccaaagtgttgggattacaggcatgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggttcagcctggacacacgccccgtgctgtgtggaggagaggaggccacacaggtgaggctgaggggcaggaagggctgggcaggaagaggctgtcccgacccctacggcacccacctgtaggcagagtctccaacagccccgtaccacacggcgttggcgcccaggaagagacagatgaggagatcgcagcaggtggccctctggatgcgagtgaaacagctacgaggcggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacacggaacgaggccttactcgcggccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggttcgcagggcgccccaatgcaggggcagaggggcagagcttggcagggtccatacagacctttgttgtcgtgccacactcggatcttccacatgctacccaggctgtgcggggtggcgatctggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacagctctgctatacacgaggagctgcggttactgcaatttgtccaataaacagcaggacctcaaggacatgattaagttacatggaaagaactgtaacttgtaacatgcaaacatggctgcacacgcctcagtccacaccacaaccagtgacccgcactgcacacctgtccacacctcagtcacgccacaaccggtgacctgcaccacacacccgtccctcagttcatgcacagactgcgaagcgtgaagctgtgtcacctcctctcccagtgacagacccaggtgacagtattttttttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaccacgccggcctaatttttttgtattttttagtagagacagggtttcaccgttagccaggatggtctcgatctcctgaccccgtgattagcctgcctcagcctcccaaagtgctcggattacaggtgtgagccaccgcacccggccgacagtttttaaaagtaggtaatcaaaagaaagaactgggaaatgaagatgaaagcagcatggaaataaaaaatgggaacacggccaggtgtggtggctcacacctgtcatcccagcactctggcaggccgaggcaggcggatcacctgaggtcaggagttcgcctggctgacatggtgaaaaattaactgggtgtggtggtgtgcacctgtactcccagctactcaggagaatcgcttaaggggaatcgcttaaacccaggagctggaagttgctgtgagccaagatcacgccattgcactccagcctgggcaacagagcgagactccgtctccaaaaaaagaaaaacgaaaacaaaaagggaatgccagaagggcaattccaaagaaaggaaaatggaggtattgaagaaacagccacggggagggtgctggcgcctccgtctgagagacgagctatgcagtcaggatcgcgggtggatgcatggtctcccacagtggtagcgatgctcacgtaacttgtggggctacgctactgtgtagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgttggctcctgtgaagacacagccgccaggcccaggaggtcacgtgcaagctgtgccttctcaggatagagccgagcccacccaggccctcctcgactctgcagaggctcccaggagcacagggtcactcacaggaaacacaaagcggatatggcttgggggcacgaagaggctggtgccgaaggcggtgaggtggcgggtgaggcagacggcctggcggggcgaggtctcctccaggggcagcagcccctctgtccgccacaccacgtcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccatgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgccccaaccgctgcatgcaccgtccagcagcgtatagttgagctgcagatgcagcacggccgcagggttgctgctgtccagggtgaccacagcaccgacggaggcctggggctggaccacaacggagttggcggagctgcggtggccccgggcagcccagtccgagttgttgggcaccttcacggtgaggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttggccggggccctgctgaaagcctaggggatggagaagtggcagccaggccctggggcgccgccatagcacagcaggctccgcgggtccgagcgcttgccctgggccacgatctcctcacccgccagcgtcaggggctcctcgttgagcacgcgggagcgcgtgacgatgggcgtgagggcagaggtcaggttgtaggcctgggacgccaccatccgcgatggtgactcggctcccagctctgagcgctgtggtgcccgcacgtctgagctggccaggtggatgaggtctcctgcagacaggcgtgaggtcagtgcagagacagggaggcagagggagggtgggggcaggcaaaaagggggagccggagggtggggactgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggggaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggagggatgaggtgaggggaagctctaggggaggggaggaggggaagggctaggggaggggaggggctaggggaggaggcaggggctaggtgaggggggaggggctaggggagggaagggggaggggaggggttaggggagggaaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaaaggctgaggctactgaagcaggtcagagaccgaggaacgccacggcaggaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacaccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctatgagcagagggggttggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgctcttgtagacacagaactctttgcagtggccctggcaacagcgctgcagcagcagggcgtacaccagcggggcgccagcatcctccgcgtcatgccagcctgagggatggtccccacagcatcacgggagggctccgtgacgtcacagagtcgggggatcccgctgctccccctacgcaggcctgcactcacccgtgcattcgaagtgcaccttggtggtgagggcgtgcacagcgcccagtgggaagaggcggcaagagccctccagcggcgggcggttgggggacagggggatggaggcacagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaagggatggtgaggggtcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactccggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgtgttctggtgtactggacccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccatgggctcagggtcaccaagcctcctggccggtccagagtggggagcatgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacatagaatttgcatcagaaacagagaggggagagcgcgcggcctccaccagcactaaaacacggaaaacagtagatgagcagggaggctgggctgtccaaggcaagtggccgaggggcgggcggcacccaccgtctggttggtggcctcctccttgcggccggccttccacacggtgaggctgaaggtgtactccacgccagctgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagtgcgggagaccccctccccatgctgggacggggcccaccaggcactgaggacgggccagccctggtggcaagctgggtgttctctgggctcatgggtgtggacgggtgaggggcagggaggacggccctgccacgcactgacctgtgtcgaagccacacaggcccactggaaactgagcggcgtctggtcgccgtcctccaggttggggtcgtaggactcgctcccatccagcaccaggtcctgtgtgtctgaccacacgcggtaggagccaccctcagtgatgggcaccaggcgctcgggggccaccgtcacattggcctggatgctccgtgccagtggcgtgtccccaaatgacacgacaaacacaaagcagtagtgccccacaggcagcgccagccacggcagcaccagctgaggccggctcacgtccacgccgggcagggccacacgcgccgggcgccccggccgctggcagctggcggtgcggtacacctcccagcggtactcagtctggtaggtgacacagtcgcgcaggtcaacgtaggcatccaggcagttgcgctgtgatcgtcgcatcagcacctgcaggggcaggaccacgtccacctccggctcccggcaggccagcacctggacggtcaccgtggcctgcgccacgaaaaagctcaccaggttggaggcgttcacctgcacgcggtagtccccaggcctcaggtaggagtgctcggccctgggctcatctgtgtcctgccctggggacccatccccaaagtcccagtggtaggccacgcgccgggggctggggctggtggcggcctcaaactgcgccgagcggttggtgaagcaggggccgctgcgcagggccacatactggacggcgtcctgaacctccagcaccagcgtgcggttctcactgcccagggcgttgaaggcacgcacctggatctccaacagccccgcggccacggcgtgtaggtgacgtcgcggcccgacaggatgaacagagagtcgccccggaccttctgcagcgagaagtaccaggcgtaggcgacccgagagccgcgctgcacgcgggctgtgaagttcctctcagtgcccatggcgatgccaggctcacagcagttgggcacctgcagcccgctcacggcctccagcaccacgatgcgcacctgcgcctgggcccagctcacgtggtttttgccctgcacgctcaccacgtggtctccgatgcgggggaagctgtgggagaaacggggcccagggagcacttcggggctggccccgccgacctgcaggcggaaggtgacagctgagccggcagccagcaggatctgaaaatggacaagctgcccgggcgccaccaccttgctgctggcccacagcaccaggcccacgatgggctcctccaccgtgaggttgtacgtggctgagacccagctgactgcgttggaggcattgagccagatgttgaaggtgccagcatccgggaagaccatggtgacatgagggccacgcttgctgctgccgccgggcacagcccagcaccagctcacattggtgcccgtggccagctgcccccaaaagggcacagaggacccggccgccacgaagctgcctcccggctcgctggccctgatgctgaggccactcacaggcacctgcacatccacttccacggtggcgttggctgagcccagcgggttccctgccgtcatggtgaccaagtgcaggccgggtgtggggaagctgtgggtggtaaatggctcgggggtctcccagctcagcccctcctccaaggaccaagtgtatacgacaccactgccaccagccagctcggcactgagggtgacgcttgtgttgacggcagctgggttcggggaggcggccaccatcagccaccccacaggctccacgaagtccacggtgcagtcagcccaggcgctgcccagcatgttggtggcccgcagctgcacatggtaggagccggcctcgagcgcggtgagcgagaagcctttgccgctgccggccagggccgggcccctgtccctccaggcagtccagctgtaggagatggtgccgtccctgaccacggcctgcagctgtaccatgtggttggtggggaagtagcggccaccgcccaccacctgcagcccctctatgagctgcaggacatagacgaagatgctgtcctgggcggagcccacctcgttctcagctgtgacgatgatattgaaggtgcccacggagcggaaggtgtaaagagatggcaggacccccagagatgggcgtgcagcggtcacagagcacccaggaatagcgcacatcactgccggcctccagcgaggtgctgaagctcatgctcccattcaggggcaccaccgtgcagctggcattgacgatgagcccccgcacgcgccgcttcaccgtcacattgagccaggcctcgctgcggctcacctcattgcagccggccaccctaacggtgaagtcacctgtgctgttgtaagcgtgggtgacctccggaccctcgagccgcccaccgtcccccagatcccacaggtagctggcggggcgcccacggcccacagcagagaacaggtacggctgctgcagctccagcccaagggagccattgaccttgatgctggtgaccagcacgggctcctgcacctccaccagggctgagtcattggcagcggagatgttgttggacgcggtgactgtcacaagataggagcctgggtctcggtagatgaacgtcacctcagggcccccgacacgggcggggacggcttcttcggtgccaaagtcccaggtgtagcggtaggggaacgggggccaggcacatgccaccagccgggcctcgtccccgagctgcacaaactgcctctctggctgcagggtgacgttgcccacctctggctccacgcagatgctggtgaagtaacgcgccctgttcacgcggctggacagcaccagcgccagggggaacgtgccgctacgcgtgaagttgtgtgtcaccgtcgggcacccccgcatggtcgtgttggaggagccatccccaaaggtccagtcgaagaggtagcgggccgggttcccggtgacgtaggccgtgagccgcgcgtcaggctgagtggggatgcaggcggcgggctcgacgcgcagcacctccaggacgaagaccagcacgtgcaggctccgggccaggtggccggcggggctggccgcacccacggtcactgtgcagttctgtgcccgcaggtacacatgctccactgtggcctctgggcccgacagcacggtgccgtcccccatgtcgaaggtccacgtgatgttgtcgcccgtctgcaccgcggcactgaccaccacgggggcgccctgctccacggccaggctcatgtccacgctgagcccgcggagctcctcaaagacgcgcacatccgcctgggccgccgcaccgctcaccgtgttgttgacctccaggcgcacgtggtagatgcccctcgagggataggtgtggttggcagccggctggctctgggtcaggacaggggagccgtccccgaagtcccacgtgtaaagaacacccccaggcgagggcagcagatgcgggtagaaggtgacgggccggccggccaccaggacgccgtcactcacacccacagcctcggagggcagggaggcgcgcacgctcacaggcacctgctgcatccggttctcgaaggcattagatgccagcacggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggcggggggcagttcagggggcccagcttccctgtccactccccccacgcctggcccctccctcaccccagtagggacctaagccatcagcccaggtgaggtcacagtgagggctgttggggaggaaggggggcagcttgactgggggactgggggtgccccgtgctcagagcctgaaaggcagtggccccctcaccccctcatccctcacctggggcagcgtaggtgtgcgtgacattgtgctccaccagcacctgggccaccgaggggtctggaactgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtgggggggcagggggtgcttgggacccagctgaggctccactctgcagtcacgccccgggcctccattcagggcccacccggctgtgctgaggcctctcccggctcccgtgcagcctcagggctcctgtgcacccagtacctcccaacagatagggaaaccgaggctcagaaaagcaaccccctgatgtggggtccctcggctgaggctggggccgggacaagagcctggtgcccaccccaaaccggcccccgagtcactcacaggaaggccacctccacagccgagtccaccagcacgcccgccgtcagtgccagcgtggcattgggggacagcacggccggcactgtggagacccgcaggccctgcatcctgttcatccgctccacggtgatgttgtagttcacggtgacgttgctcacgtggttggaggccgtcagctgcagggataggcatcagtgggcccaggtggcaggtgagaggcctggccctgcttagcgtccctccctccactcacccacagccatggcagcgtcctcgggcagcatgaagcagaggtgaaggtggagcccgccccgccccaccccatcccctcccctccccacccccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcaggctggagagtcccacgcggggcacagaggagaggaggtggccggggctctgcatgccatgggagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagacggagacagccctgtcccccatgtacccagcatggtggcaccgcgggcagcccgcagtttcccatcaggggttcagactccacctcaaaagccactcgctttagccaggtgagaacacagcagagggcgtgagagactcacgggggctcgtgtgaggtcagggagcggagttttaaattcatttcatgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcacgccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgagcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcgggagggcgccagggccagcgtcgtgctgcaagccaacgaggtcaccagggagcatgaggacatcctggccgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgtctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggcccctgacgtgcagccattggcgcaggcctggggtggcaggaggcgtccagcggcaagcagatgttggctccagggcaccagcgtccccctggcatgcacgcgggggccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcccaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaagggggtaatgtgagtaaacgctttcctctctgcactctggattttcccaaccatcttcactgggcacaagcaacattaaggcccccaagttttttggggagacccacagtgggcagggcaggcgaggcctccaggggcaggcaggagggcaggttttagaacgtggggggccgactacctccacgggctcatgcggggctgagaggccgtcctgccgtgccagaggcatcaggggtccctgcaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggggctgggcccacctccaccccctgcacagtcgagaagccgatccacatgtctaggctcctgggggcgggtgtgggatggcagggggctcagggcactcctccatcctcccaccctcacagcagcccactgggagccccgtcactgtccccctttccagatggggaaactgaggctcagagcccggagagcagggcccaccagcccaggctcacagcagcacccacccacgaggcctgtgggcactggcagggatccccgtgcaggccacctcccgtatggcgtgcccaggagtgtccggaggctgcccccagctcgtgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcatggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaacgagggtgtcaacggtcagtgtgggcccaaaacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccatcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacatttccagcatccccaagctaaggcctcccacccttgagctccccactcccagaggtcaggaggggcctttctgatggaagacccaaatgaacactcatctggggaaaccaagccaggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccagtctcgaaagaaaagaaagagaaagcaagaaaagaaagatggctgggcacggtggctcactcctgtaatcccagcactttgggaggccaaggtgggtggatcatgagatcaagagatcaagaccatcctggccaacagggtgaaaccccgtctctactaaaaatgcaaaaattagctgggcgtggtggcgggcaccagtccaggctactcgggaggctgaggcaggagaatggtgtgaacccaggaggcggagcttgcagtgagccgagatggcactgctgcactccagcctgggcaacagagtgagactccatctcaaataataataaaaaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagctgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggtggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcacttgaaccagggagtcggaggttgcggcgagctgagatcatgccactgcactgcggcctggagacaagagcaagactccgtctcaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcggtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatacaaaattagccaggcatggtggtgcacgcctgtaatcccagctactcgggaggctgaggcaggaaaagcgcttgaacccaggaggcggaggttgccatgagccgagatcgtgccattgcactccagccttggcaacaagagtgaactctgtctcaaaaaaaaaaacaaaaaacacatgggtcaggaggggaagggtcggggcagggagggcagggcaggctctggggtggggggtctgtgagtcagccacggctctgcccacgtctccccacgaagcttcgagccatgcagagcagcacgttttgcagtacgccatcttttccaaaagccaccacctctcggcagcatccttaacccaaggcaggctgtggcctcagaagccccggctgtcctccacctggaactggacacagctgtccctgctgagcttcagcagccagggagccacaagtggagaggcacctgcgtgagccccccaggaaggctactggtgacacccagacagcaacgctcctggacccttgaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggttccactgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccatccaatgtttagaaagcctggggatgtgccacgtcccccagggatccagcacgcacccaaagagacactgtcccggcgaggagcctggagcctgggaaatacaaggcatcagactggtaccaagactctccccagcgctggggacaactgtctgcttatcttagtcccctgcgcccttttcaatccaaccctgggtcctgggcacctcatagttccaaacccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcacggtctttgctcacaccgttcaccccccttcttctggacccacctcatcgccccttcctaagcatcagcccaattcttgcacatccatcaaatccttgtccagacacctcctggaactcttccctgcagccccctacagccatccccatctctccgggtaccccgcagccccaggccgaatcccaattcctctccaattagcgactgtttgtcctcccagctgagcgcggcctccgcgccccgcccccgctggcgtccgcagagcccccgggtgggacgtctgtctccagacccggggtttttcggctccccggggccgtgccaaccgcggctccaggcgttccttatttagcagggccgctgtgccgcgccggagcctcgccctgggagcgtcctggcccgcgtcctgcttcccgtcccgggccagggaacgcgcccacgcccgcccgtcccgcggcctctcccgggtgccgctgggcccgctactcacagcgctgtggcgtccgcggggatgcgcagcgcgggaccgagcgtccgcagcccgcggcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcggacggcatggcgggcgcggggctggatggggctgcggccgcgacctgctgctgagcgacgcccgctcggggctcggggccaggccgctccgggagctcggccgcccgctcggacgttggcgctgcagtgcgggccccgccgcggctcctcctcctcctccccgcgcggcgcagggcggacggggcgagggggggcggggcgggtgcaggctccgcccccttcgccacagcgcgaccgggccagcgatgagggactggcatccggaggcttcaccctccgctccacagggtcggcagcagggcggggcctccggaagctccgccccacgctttcccggggcgcatgcgacgtggggcggagcgtctggaagctccgcccgtcgcactgtagagtcggccgaggcgcacgaggtatttttcacgctccgcccctctgcaggctaaagtgcgtgggcgggaagcggtgggcagggtgccatctggctccgcccttctcctgtggtgtgggccaggcggcggcttcctcctcctgcagcagccacaggctccactctgatccttctcccgcggcatggatccttctcccgcggcgtggatccttctcccgcaatctccgtgcgcgtccccagtcagtacccgcagcctcccgacgcacccgctggctccaagcctccctaccccaggtttcctggctaagagagagacagagggagagagggggaagagagagaacaggcaatgggaggttgatggtgagagcttattgaaagacaagagggaggaaacccacatccttcattccccatccattcatttattgccttatttattccattgaatcttcacagctctagaaaaagtgtgctacaattattccctttattaaatgaggtcactgaggcacagtttaagaaatttgccagcagggcacagtgggtcactccggtaatcccagaactttgagagggggaggaaggtggatcccttgagcccaggagttggagaccagcctggccaacatggcgagaccccgtttctacaaaaattagccaaaattagccaaactggctcacacttgtagtcccaggtactcgagaggctgaggccggaggagcgtgtgagcccaggaggcagtggctgcgctgagccgtgattgtgccactgcactccagcctgggcaacagagtaagaccctgtctcgaaaaaaaaaaaatggaaaaaagaaaaaaagaactggctgggagtggtggctcatgcctgtaatcccagcactttgggaggccgaggtgggtggatcacctgaggtcaggagtttgagaccaacctgaccaacaaggtgaaatcccatttctactaaaaatacaaaaattagccaggcgtggtggcaggtgcctgtagtcccagctactagggaggctgagacaggagaatagcttgaacctgggaggcagaggttgcagtgagccgagattgcaccactgcactccagactgggcaatacagtgagactccgtctcaaaaaaacaaaaaaaatcctaccacatgtgctccaccaagctctgtctccaaggtggccttggaagccacatggggaaggtggcagagactctaggagcctgagcagaaatccagatgattatgaaaaatgcagacctacccatccttattcacctgggaccaccgtgaactatatcataagaaataaacccctattgtacatacatgcaccattcgagttgggtctatttgttacagcagtttagccaaccctaatccacatatacagtgtcaacagtggctgagatgacatgttgcacagacatgagagtcagaaagacctgagttcaagtcccagtgatgacatttactatctgtgtgaccttgaaaagctgcctaactactctcagaccgtttcctcatcagtttgttttgagagtcaaatgagaaaattactaaaaagcccttagcactgcatctaagatggggaagagacagtcaatgaattcaagtttcctgaagcccagttgcatccctgccctgccctgggctctgagagacagttgccgaagctagtgttaaagtgaactaaatatggcctgagtgggacttcgtacttctatagttgagtccttgtggacaaattgcaacctagcttaataggtagacaagattgaaaacctaacttaggagtatgcgcctgtaacaatagctgagtcttggccaatcccagaggccgtagttcaaccgctcatacgctgctgagtgttcaaactgtactcaaataaggcaaacgccaacttgtaacaatccagccattctgtacttcacttctgatttctgtacatcatttcccttcttttgtccataaatcttcttccaccacgtggctgcgctggagtctctatgaatctgctgtgattctggggtctgcccaattcgcgaatcattcattgctcaattaaactactttaaatttaattcagctgagattttcttttatcactaatttgagctggttttctaatgtttgcaaatgggagggctgactaatataacactgctccaaatattaacgtctttctcccaacccatcacccaggcagaagtggtccagcctgggcaaccctaggaggaggctagctctcctctaggaaggcttaggatgcagccagtgggcagtaactggctcactgtcccctgcaactgaaatcagaactggttccagaaaccaagttgacccccaaccagtctttcccaaaatatggctctatgcccatctctggtcaggctgggctgttttcctggacagagaagtctcagacaagcaggcagtggttagtgggctgtgcccaggctgagaacatttcccagagaagatggcatctctggcagtcccttaaagccagcagaggccaagtcatgtccaagaggccaaaaggcccaatatggtggagacagtatacagtccccatgaataagggatgctgatgccttccctatgtaccaggtagtcactgcctgaggggcccagagcagcaggagggcagagccagcctgggcaggggcactgggccggaagtggggctcacatcctcagcacacacacacacacacacacacacacacacacaagcgaatgcacacacacacacacaaatgcacgcacacacagataggtgcattcaaacatcacatacacgtgtacattccttgcaaaatcaacttctgctgatagcacaacaaacaatggggccacagtgtggcatggaggaaaccctggagtctgatctcatttttttttttttgcatctgtcaggggataaagatatttgataaaaatccttgagtcacatccccaccaggtccctgcctacctgtagaccccatcaagccagctccatggcccttcagataccgcctcactgggtccccagggattgacctcagtcctggaaatgcagaaatatctgtatctgtcacagctgagactggcggccttccgccggctttcctggaggcagagctggagacagggacttgggtggatgtggtttttgtttttgttttgaaaggggctttcaggagaagggaggtgaggactacaggatgcagaaggggacagagcagagtgagaatgtggtcccttaaagtcccgccttgacctatcccacgagcagcagagagcacgccacaggatcgtccccaccgtggggcagggaccagccattcacgttgctgtatcagttagtcactgggccattactgggcatggcatcccatcccaggcaatgtggctcccatctgagggtgattctctagagaaggacagctgtgagctctcagcaggtgaggctccaaaagcagctataccagtctagacctcaggggaagggggaattcatctctaggcagggatgattttcataacattgaactcttgacatgcaggagcaccgaccaatcagaacagacacggtgaccaaacaggcacagccacaccagtggataccagcggaatgtccacgctgcctctgcgaagggacagtcccatgagccaagccctagaccagctgttctgggagcactgcatcattgcactgaattctcacaaccgccccataatgctgggaccatccccattttcttgcccaacagcctccgtctcatagacactaggcggctctcccagggtcacacggtccagtcaataacgggcagaactcgcactccgatctgtctggctccaaagctgctaaaaattttctacttggcctcactggcttgacaaagataaaaaagaaggcaagtccttctttccaagagatgctgaggtccctcggtgacactaggtcatgattttatcatgttcagagggcaatgaaagggacagaaaacaagcgatgtgtgatctcctgtcatgtcaagagacgctgttttcaaagaaacgtacgtttcgcagaatcaatacgctgtggggcctcagaaagcagaggcagacacacggccccaacccgtgcacgtgggagccctgttacaagagacggcagaaattaaactgaatcacctggagcaagtacattgtaaatgttcaatattaatgacccacctcggccccaaagaagagagcgttgggctttgtccagctgtgtgctctgttgttaaaagaccaccttgtggccaggcacggtggctcacacctgtaatcccagcgctttgggaggccaaagcaggtggatcacctgcggtcaggagttcgagaccagcctggtcaacatagtgaaaccccgtcgctactaaaaatacaaaaatttgctggatgtggtggctggcgcctgtaatcctagctactcgggaggttgaggcaggagaatcgcttgaacctgggaggcggaggttgcagtgagccaagatcacgccattgcactccagcctgggcgacaagactgaaactccgtctcaaaaacaaacaaacaaacaaacaacaacagaaaacaatttgtgccttaatgggcattcctttcccttcttgctaagggatgagatgatggcagaacttgtggccactgtcctggaggttgacaagctttttctgtaaagtgctagataataaatattttgtgggccacacgatctctggtgcaactactcaacactgccattgtcatgcaaatgtagccatagatgataataaatgaatgggtgtgactgtgttccaataaaactttatttataaaacagacagctggccagagttgggcaatgggcagtagtttgccccccactccccgcccatccgtcctattccttggcttttttgggtacatcaaggagtgcagtctggatgctgggctattttatggccactgggcataaccttaacctgggccttttgtctgttaacctgggtcagtggctacggtgaaggtcgggcaaccaaggtttagatggctcagtacacattcacgcccacaaaccaaaccaggaaaaagatgtgctaagttgagcatatgacactgttggtactcaaatggtttgtttttttttttaaataaatgtttaagtaaattttttattttagaacagttttagaaaaatggtgaaagcagtacagagagtttccatgtaccccatagcttgatgcattatgaactaaagtccatactttttttaggggggtggggacagggtcttgctcgtcacctaggctggagtgtggtggtgtgatcatagttcatggcagcctcaaccctccacctcccctggctcaagcgatcctccatctcagcctcccaagtagctggaaatacaggtgcctgctaccatccccagagaatttgtttttgtttgtttgtttgttgtttgtttgttgagacagggtctcactctcattgcccatgctggtatacagtggcacaatcacgggtcacttgcagccttgacttcccggactcaagtgatcctcccatctcagcctcccgagtagctaggactacaggtgcacaccacaagcctggctaattttttgtattttttgtagagatggggtttcgccatgtcgcccaggctggtcttgaactcctgggctcaacccatccgccggcctcggcctcacaaagtgctagggttacaggcgcgagccaccgtgcctggccacctaaagtccatagttgattctgattgccttagtttttgcttaatgtcctttttctgttccaggataccacatggagcattttgaggagtgctggccaggtattttgtagaatgttcctcaactgggatttggcagatgcttctcatccttagtcttggcttgtgtgtgttttgaggaggaggaccacagagcttaagaatcattctcagcactctgtatcaggcacgcattctctcaagatgacttgccgctattgaagttgactttgatcacctggctgaggtagtctgtccgtgttctccactgtaaagttactctctcctctcttttcacactgtactctttggaagagagtcactatgcacagcccacacttaggatgtgggaagtccgctccacctccttgacgatggaatagctatataaattacctggggccgggcacggtggctcacacctgtcatcccagcacttgaatgggaggccgaggagggtgatcacttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccaacctgggcaacagagcaagaccctgtgtaaaaaaaaaaaattaaataaaaataaataaataatctggaattcttctgcctgggagatttgtctcttctctcttatctgatcatttatagcagtatggaatcatgggtatttattctttgaattctaatccaatagtacttttttggggctcaaattgttctggctttgacccctgggagcttttccactggctcctgtgtccctctgagatgccccatcactgcagcagtttcattttgtttcatttagcgcctcctcaccctgtgaccctacaagatgcttcaggttcttcttatctatttcctccctcggtcctaggatcgacatttgttcaagaagcctggttccttttactggagaatggtgtttattggagaacagagacctgggcaccagaggtttgttgctactggggtatccttgcttctaggctctcttcgctgacagccaggattagtaatgtgtgtcttactaatttgtgtatatgcacatatccataaatatttctctatgtagccatctgtatctatattgagctaaacatgtgttcatactgatgcctgccactctaatccactgccacatggatcactctagccttgcctcctttgccgacctgtaaacctcccgccccccaccccatctattacttaatgaatttcagtaagcatgtgaggtgggtggttatggaaaccatttttgacctatatataagatggcagtttcgtctgatttctcctaaatagaagacgagtgtgaaatggtaacatggtgtccgtaggagtcatatggatggaccatggccaaccatattattaaggaatattcatgcattcatccatccatccatccatccatccatccatccatccattcattcaccagtgaatgagtaaagcattaggtattcaccacactgtcctctcctggacttccccctacctcacgggccacttcctctctgtctcttgggcagggccctcctcgcccatcctctgaaggttgcactgtcccagggcttggcccccagccctctccttttctcagtcttcataaggatacctattattcaatcccgtggcctcatctgtcatccaaaaacactcccagctcaccacgtctcatctccagccgtgatttctcacccaggctgcagactcgggtgtctgataagcatctcaaactcacgatggccaaaacagaagtctcaatttacctacacatttcagtggttcagctagaaacaaacgattcacttatcgttgattcctcccttccctcacctcctgtattaaatacatcagcaagacctttctgctctatctctgaagcatagccccaagctcaccacttcctgccactgttacttccatcaccccaatccaagccattgctgtcttttgcctaaaccaacacaacgtcctctttgcttctctccctaaattcattcttgcttcccaataatccaatctcctcaaaatttaaagaagcaattgtttaaaaacatacatcagatcactcccctttccctacttaaaccctccaatgccttctgttgccattagaataaaatctaaactcctttccagggcacccacatgacccggtccctgccatcgttctcatctcttcctctcaatcacttgactctggccaccctggcctctttgctattcctgaaactcagggagctcatttcctcctgggggcctttgcaattatggtcccctctgcctgggcagctcttcccccagatctttgcataactggcccttcccctcctcaggtctcagctcagatgctgcctcctcagagagaccttccatgataccaatcatcctctgtcacattgccttgttctgcttcttttcttcgtaacgcctggcattatccaacaacttctaatgtgtgtgtttacctttcgtcctccatcagcactgtgctcctaagagctgaggctcggtctctctcacaccactaaacccccagtatgccaagcagcacccagcacaggggagatgctcagttaatacttgttgaatgaattaatgatgctccccctaaaactaaactttacaaagcacccactagacaacaggttagaaaacattttctaggccaggcgcagtggctcacacctgtaatcccagcactttgggaggctgaggcaggcagatcatctgaggtcggggtttgagaccagcctggccaacatggtaaagccctgtttctactaaaaatgcaaaaattagccaggcttggtggcaggcgcctataatcccagctactagggaggctgaggcacgataatcatttgaacccaagaggcggaggttgcagtgagctgagatcacaccactgcactccagcctgggtgacagagaaagaccccatctcaaaaacaacaacaacaacaacaaaatgtcttctgtaaagacccagatagcaagtattttaggctttttaggctacctggtctttgccacaactacttacatctggcactgtcaggcaaaagcagccataatctgcaaatgaatgggcatggctgtgtgctcataacactttatttataaaacaagaacagtgggccatagtttgctaacccctgcactagcccagtctaagtcttgaatatcatctgtgtaattaattcacagtgaggagttctccactgtaataattactcattccatgaatgcatgccactcaggtgaggcgttcttgaaactctgagaggcaagaagcaaaatgttctttctccatacccaggcacactccagtctgtgaaaaggaagcaagagaggcaggctgcaagtttgatcactgggtggctgctagccacctctccccctcagctccaagagcagaaacaggatgaaaacgcagcagctgccggcttctgtcctcttgccagctgcctctcttgcaagactagacagggaggggcagccgccagtctccggaggcacagactgcacagaattgaggatcacttgttccaatgcattcatcttatcttacaaaatcttcaaattccaaaaagcacacgtaagaagggctgctgtttcattcacacagtgaaatattgtgcatctgaaagaatatgtagatgggtggcatcttcaacaaccccaggatcacagacgtttaaatttcaccccttctactgctgtaaggcacagcagaaggagtgtaatttaaacgtctgtgatcctg

SEQ ID NO: 1519 - DNA, 3510470 bp, Homo sapiens; identical to SEQ ID NO: 1518

SEQ ID NO: 1520 - DNA, 3510470 bp, Homo sapiens; identical to SEQ ID NO: 1518
